United States Patent
Madison et al.

(10) Patent No.: US 9,795,655 B2
(45) Date of Patent: Oct. 24, 2017

(54) MODIFIED MT-SP1 PROTEASES THAT INHIBIT COMPLEMENT ACTIVATION

(71) Applicants: Edwin L. Madison, San Francisco, CA (US); Jack Nguyen, Oakland, CA (US); Sandra Waugh Ruggles, Sunnyvale, CA (US); Christopher Thanos, Tiburon, CA (US)

(72) Inventors: Edwin L. Madison, San Francisco, CA (US); Jack Nguyen, Oakland, CA (US); Sandra Waugh Ruggles, Sunnyvale, CA (US); Christopher Thanos, Tiburon, CA (US)

(73) Assignee: Catalyst Biosciences, Inc., South San Francisco, CA (US)

( * ) Notice: Subject to any disclaimer, the term of this patent is extended or adjusted under 35 U.S.C. 154(b) by 0 days.

(21) Appl. No.: 14/275,772

(22) Filed: May 12, 2014

(65) Prior Publication Data

US 2014/0242062 A1  Aug. 28, 2014

Related U.S. Application Data

(60) Continuation of application No. 13/506,603, filed on Apr. 30, 2012, now abandoned, which is a division of application No. 11/584,776, filed on Oct. 20, 2006, now abandoned.

(60) Provisional application No. 60/729,817, filed on Oct. 21, 2005.

(51) Int. Cl.
*A61K 38/48* (2006.01)
*A61K 38/49* (2006.01)
*C12N 9/64* (2006.01)

(52) U.S. Cl.
CPC ............ *A61K 38/482* (2013.01); *A61K 38/49* (2013.01); *C12N 9/6421* (2013.01); *C12N 9/6424* (2013.01); *C12N 9/6467* (2013.01); *C07K 2319/00* (2013.01); *C12Y 304/21109* (2013.01)

(58) Field of Classification Search
None
See application file for complete search history.

(56) References Cited

U.S. PATENT DOCUMENTS

| | | | |
|---|---|---|---|
| 4,044,126 A | 8/1977 | Cook et al. | 514/180 |
| 4,364,923 A | 12/1982 | Cook et al. | 424/46 |
| 4,414,209 A | 11/1983 | Cook et al. | 514/180 |
| 4,522,811 A | 6/1985 | Eppstein et al. | 514/2.4 |
| 4,624,846 A | 11/1986 | Goldenberg | 424/1.1 |
| 4,892,538 A | 1/1990 | Aebischer et al. | 604/891.1 |
| 5,283,187 A | 2/1994 | Aebischer et al. | 435/182 |
| 5,486,602 A | 1/1996 | Sambrook et al. | 536/23.2 |
| 5,792,616 A | 8/1998 | Persico et al. | 435/7.21 |
| 5,869,615 A | 2/1999 | Hourcade et al. | 530/380 |
| 6,271,012 B1 | 8/2001 | Van Eekelen et al. | 435/221 |
| 6,383,775 B1 | 5/2002 | Duff et al. | 435/69.1 |
| 6,483,011 B1 | 11/2002 | Stemmer et al. | 800/284 |
| 6,902,918 B1 | 6/2005 | Arnold et al. | 435/189 |
| 7,030,231 B1 | 4/2006 | Craik et al. | 536/23.1 |
| 7,227,009 B2 | 6/2007 | Craik et al. | 536/23.1 |
| 7,335,504 B2 | 2/2008 | Haupts et al. | 435/226 |
| 7,700,341 B2 | 4/2010 | Madison et al. | 435/212 |
| 7,939,304 B2 | 5/2011 | Ruggles et al. | 435/183 |
| 8,211,428 B2 | 7/2012 | Madison | 424/94.64 |
| 8,383,388 B2 | 2/2013 | Oyhenart et al. | 435/226 |
| 8,445,245 B2 | 5/2013 | Ruggles et al. | 435/183 |
| 8,519,103 B2 | 8/2013 | Madison et al. | 530/384 |
| 8,663,633 B2 | 3/2014 | Madison et al. | 424/94.64 |
| 8,778,870 B2 | 7/2014 | Madison et al. | 424/93.72 |
| 2002/0031801 A1 | 3/2002 | Kapeller-Libermann | 435/69.1 |
| 2002/0034776 A1 | 3/2002 | Bornscheuer et al. | 435/69.1 |
| 2002/0192754 A1 | 12/2002 | Jenne et al. | 435/69.1 |
| 2003/0050251 A1 | 3/2003 | Semple et al. | 560/159 |
| 2003/0086919 A1 | 5/2003 | Rosenblum et al. | 424/94.63 |
| 2003/0119168 A1 | 6/2003 | Madison et al. | 435/226 |
| 2003/0134298 A1 | 7/2003 | Madison et al. | 435/6.16 |
| 2003/0134794 A1 | 7/2003 | Madison et al. | 435/226 |
| 2003/0143219 A1 | 7/2003 | Madison et al. | 424/94.67 |

(Continued)

FOREIGN PATENT DOCUMENTS

| | | |
|---|---|---|
| CA | 2343931 | 9/1999 |
| CA | 2501295 | 4/2004 |

(Continued)

OTHER PUBLICATIONS

Oberst et al, The Activation of Matriptase Requires Its Noncatalytic Domains, Serine Protease Domain, and Its Cognate Inhibitor. J. Biol. Chem vol. 278, No. 29, Issue of Jul. 18, pp. 26773-26779, 2003.*

Guo et al, Protein tolerance to random amino acid change. Proc Natl Acad Sci U S A. Jun. 22, 2004;101(25):9205-9210. Epub Jun. 14, 2004.*

Nilsson et al, Simplified assays of hemolytic activity of the classical and alternative complement pathways. J Immunol Methods. Aug. 3, 1984;72(1):49-59.*

Hartung et al, Stimulation of PGE and TXB2 release from macrophages by C3b. Agents and Actions Sep. 1983, vol. 13, Issue 5-6, pp. 434-435.*

Letter/Written Disclosure of the Supplement Information Disclosure Statement for the above-referenced application, dated Sep. 22, 2015, 2 pages.

Folz et al., "Substrate specificity of eukaryotic signal petptidase," J. Biol. Chem. 263(4):2070-2078 (1988).

Translation of Official Notification, dated Jun. 25, 2014, in connection with corresponding Israeli Patent Application No. 190954, 2 pages.

(Continued)

*Primary Examiner* — Sheridan Swope
(74) *Attorney, Agent, or Firm* — Dentons US LLP; Stephanie Seidman

(57) ABSTRACT

Provided are methods for and compounds for modulating the complement system. In particular, compounds are provided that inhibit complement activation and compounds are provided that promote complement activation. The compounds are therapeutics by virtue of their effects on the complement system. Hence, the compounds that inhibit complement activation can be used for treatment of ischemic and reperfusion disorders, including myocardial infarction and stroke, sepsis, autoimmune diseases, inflammatory diseases and diseases with an inflammatory component, including Alzheimer's Disease and other neurodegenerative disorders.

12 Claims, 1 Drawing Sheet

(56) References Cited

U.S. PATENT DOCUMENTS

| | | | |
|---|---|---|---|
| 2003/0186329 A1 | 10/2003 | Madison et al. | 435/7.1 |
| 2003/0186384 A1 | 10/2003 | Barth et al. | 435/69.5 |
| 2004/0001801 A1 | 1/2004 | Madison et al. | 424/85.1 |
| 2004/0072276 A1 | 4/2004 | Koltermann et al. | 435/23 |
| 2004/0115727 A1 | 6/2004 | Steward et al. | 435/7.1 |
| 2004/0146938 A1 | 7/2004 | Nguyen et al. | 435/7.1 |
| 2004/0175777 A1 | 9/2004 | Harris et al. | 435/23 |
| 2004/0259771 A1 | 12/2004 | Stahl et al. | 424/192.1 |
| 2005/0002897 A1 | 1/2005 | Haupts et al. | 514/8 |
| 2005/0019863 A1 | 1/2005 | Sarmientos et al. | 435/69.1 |
| 2005/0032157 A1 | 2/2005 | Gal et al. | 435/226 |
| 2005/0059126 A1 | 3/2005 | Haupts et al. | 506/1 |
| 2005/0112579 A1 | 5/2005 | Madison et al. | 435/6.16 |
| 2005/0158297 A1 | 7/2005 | Jensenius et al. | 424/94.6 |
| 2005/0175581 A1 | 8/2005 | Haupts et al. | 424/85.1 |
| 2006/0002916 A1 | 1/2006 | Ruggles et al. | 424/94.63 |
| 2006/0024289 A1 | 2/2006 | Ruggles et al. | 424/94.64 |
| 2006/0029590 A1 | 2/2006 | Thanos et al. | 424/94.63 |
| 2006/0099625 A1 | 5/2006 | Craik et al. | 435/6.16 |
| 2006/0104979 A1 | 5/2006 | Craik et al. | 424/146.1 |
| 2006/0171884 A1 | 8/2006 | Foltz et al. | 424/1.49 |
| 2006/0269538 A1 | 11/2006 | Koltermann et al. | 424/94.63 |
| 2007/0093443 A1 | 4/2007 | Madison et al. | 514/44 |
| 2008/0051559 A1 | 2/2008 | Craik et al. | 530/350 |
| 2008/0102115 A1 | 5/2008 | Oyhenart et al. | 424/457 |
| 2008/0160558 A1 | 7/2008 | Koltermann et al. | 435/23 |
| 2009/0047210 A1 | 2/2009 | Ruggles et al. | 424/1.11 |
| 2009/0098103 A1 | 4/2009 | Madison et al. | 424/94.64 |
| 2009/0123452 A1 | 5/2009 | Madison | 424/94.64 |
| 2009/0136477 A1 | 5/2009 | Nguyen et al. | 424/94.64 |
| 2009/0208440 A1 | 8/2009 | Haupts et al. | 424/70.14 |
| 2009/0208474 A1 | 8/2009 | Haupts et al. | 424/94.3 |
| 2009/0291890 A1 | 11/2009 | Madison et al. | 514/14.3 |
| 2010/0166729 A9 | 7/2010 | Madison | 424/94.64 |
| 2011/0177581 A1 | 7/2011 | Ruggles et al. | 435/212 |
| 2012/0244139 A1 | 9/2012 | Madison et al. | 424/94.63 |
| 2012/0301945 A1 | 11/2012 | Madison et al. | 435/219 |
| 2012/0308540 A1 | 12/2012 | Madison et al. | 424/93.72 |
| 2012/0308551 A1 | 12/2012 | Madison | 424/94.64 |
| 2013/0164820 A9 | 6/2013 | Madison | 435/219 |
| 2013/0177541 A9 | 7/2013 | Madison et al. | 424/93.72 |
| 2013/0243855 A1 | 9/2013 | Oyhenart et al. | 424/463 |
| 2014/0030247 A1 | 1/2014 | Madison et al. | 514/1.1 |
| 2014/0030791 A1 | 1/2014 | Ruggles et al. | 435/183 |
| 2014/0044701 A1 | 2/2014 | Madison et al. | 530/384 |
| 2014/0234290 A1 | 8/2014 | Madison et al. | 514/1.1 |
| 2014/0322191 A1 | 10/2014 | Madison | 424/94.3 |

FOREIGN PATENT DOCUMENTS

| | | |
|---|---|---|
| CA | 2562729 | 11/2005 |
| EP | 0 092 182 | 10/1983 |
| EP | 0 238 473 | 9/1987 |
| EP | 0 277 313 | 8/1988 |
| EP | 0 299 706 | 1/1989 |
| EP | 1 361 284 | 11/2003 |
| EP | 1 726 643 | 11/2006 |
| EP | 1 504 117 | 7/2007 |
| EP | 1 633 865 | 9/2011 |
| JP | A-2001-517449 | 10/2001 |
| WO | WO 92/06203 | 4/1992 |
| WO | WO 99/15675 | 4/1999 |
| WO | WO 99/43840 | 9/1999 |
| WO | WO 00/17370 | 3/2000 |
| WO | WO 00/53232 | 9/2000 |
| WO | WO 00/68247 | 11/2000 |
| WO | WO 01/18215 | 3/2001 |
| WO | WO 01/18216 | 3/2001 |
| WO | WO 01/23524 | 4/2001 |
| WO | WO 01/42432 | 4/2001 |
| WO | WO 01/32711 | 5/2001 |
| WO | WO 01/57194 | 8/2001 |
| WO | WO 01/80880 | 11/2001 |
| WO | WO 01/91798 | 12/2001 |
| WO | WO 02/08392 | 1/2002 |
| WO | WO 02/20475 | 3/2002 |
| WO | WO 02/072786 | 9/2002 |
| WO | WO 02/077263 | 10/2002 |
| WO | WO 02/077267 | 10/2002 |
| WO | WO 02/092841 | 11/2002 |
| WO | WO 02/095007 | 11/2002 |
| WO | WO 03/004681 | 1/2003 |
| WO | WO 03/031585 | 4/2003 |
| WO | WO 03/044179 | 5/2003 |
| WO | WO 03/095670 | 11/2003 |
| WO | WO 03/104394 | 12/2003 |
| WO | WO 2004/031733 | 4/2004 |
| WO | WO 2004/005471 | 10/2004 |
| WO | WO 2004/093797 | 11/2004 |
| WO | WO 2004/111226 | 12/2004 |
| WO | WO 2004/113521 | 12/2004 |
| WO | WO 2004/113522 | 12/2004 |
| WO | WO 2005/059142 | 6/2005 |
| WO | WO 2005/100556 | 10/2005 |
| WO | WO 2005/110453 | 11/2005 |
| WO | WO 2005/123119 | 12/2005 |
| WO | WO 2006/067198 | 6/2006 |
| WO | WO 2006/125827 | 11/2006 |
| WO | WO 2007/047995 | 4/2007 |
| WO | WO 2007/149406 | 12/2007 |
| WO | WO 2008/045148 | 4/2008 |
| WO | WO 2008/127702 | 10/2008 |

OTHER PUBLICATIONS

Response, submitted Aug. 5, 2014, to Examiner's Report, dated Feb. 8, 2013, in connection with corresponding New Zealand Patent Application No. 606504, 13 pages.
Response, dated Aug. 5, 2014, to Official Action, dated Feb. 5, 2014, in connection with corresponding Korean Patent Application No. 10-2013-7034742 [English instructions and original document in Korean], 95 pages.
Decision of Rejection, dated Aug. 11, 2014, in connection with corresponding Chinese Patent Application No. 201110327286.0 [English translation and original document in Chinese], 7 pages.
Notice of Acceptance, dated Aug. 25, 2014, in connection with corresponding New Zealand Patent Application No. 606504, 1 page.
Examination Report, dated Sep. 29, 2014, in connection with corresponding European Patent Application No. 11169348.7, 4 pages.
Response, dated Oct. 14, 2014, to Official Action, dated Apr. 15, 2014, in connection with corresponding Japanese Patent Application No. 2012-223555 [English instructions and original document in Japanese], 34 pages.
Response, dated Nov. 26, 2014, to Decision of Rejection, dated Aug. 11, 2014, in connection with corresponding Chinese Patent Application No. 201110327286.0 [English instructions and original document in Chinese], 23 pages.
Response, dated Dec. 23, 2014, to Official Notification, dated Jun. 25, 2014, in connection with corresponding Israeli Patent Application No. 190954, 49 pages.
Office Action, dated Dec. 29, 2014, in connection with corresponding Korean Patent Application No. 10-2013-7034742 [English translation and original document in Korean], 92 pages.
Request for Reinstatement and Response, dated Jan. 28, 2015, to Examiner's Report, dated Jul. 29, 2019, in connection with corresponding Canadian Patent Application No. 2626356, 65 pages.
Search Report and Written Opinion, dated Feb. 27, 2015, in connection with corresponding Singapore Patent Application No. 2013044581, 14 pages.
Office Action, dated Mar. 3, 2015, in connection with corresponding corresponding Japanese Patent Application No. 2012-223555, 6 pages [English translation and original document in Japanese].
Response, dated Mar. 30, 2015, to Examination Report, dated Sep. 29, 2014, in connection with corresponding European Patent Application No. 11169348.7, 16 pages.
Examination Report, dated Jun. 5, 2015, in connection with corresponding European Patent Application No. 11169348.7, 6 pages.
Response, dated Jun. 23, 2015, to Office Action, dated Dec. 29, 2014, in connection with corresponding Korean Patent Application No. 10-2013-7034742 [English instructions and original document in Korean], 67 pages.

(56) References Cited

OTHER PUBLICATIONS

Response, dated Jul. 27, 2015, to Search Report and Written Opinion, dated Feb. 27, 2015, in connection with corresponding Singapore Patent Application No. 2013044581, 14 pages.
Response, dated Sep. 2, 2015, to Office Action, dated Mar. 3, 2015, in connection with corresponding corresponding Japanese Patent Application No. 2012-223555, 30 pages [English translation and original document in Japanese].
Email, dated Sep. 16, 2015, summarizing a telephonic interview with the Examiner, in connection with corresponding Japanese Patent Application No. 2012-223555, 2 pages.
U.S. Appl. No. 13/986,644, filed May 20, 2013.
U.S. Appl. No. 14/267,754, filed May 1, 2014.
U.S. Appl. No. 14/244,840, filed Apr. 3, 2014.
Letter/Written Disclosure of the Supplemental Information Disclosure Statement for the above-referenced application, dated Jul. 1, 2014, 2 pages.
"The Membrane Attack Complex (MAC)," Microbiology @ Leicester. http://www-micro.msb.le.ac.uk/MBChB/Merralls/MAC.html (accessed on Jul. 14, 2005) [online].
Adams et al., "Contribution of the repeating domains of membrane cofactor protein (CD46) of the complement system to ligand binding and cofactor activity," J. Immunol. 147(9):3005-3011 (1991).
Adams et al., "The c-myc oncogene driven by immunoglobulin enhancers induces lymphoid malignancy in transgenic mice," Nature 318:533-538 (1985).
Alexander et al., "Expression of the c-myc oncogene under control of an immunoglobulin enhancer in E mu-myc transgenic mice," Mol. Cell Biol. 7:1436-1444 (1987).
Altschul, S., "Basic local alignment search tool," J Molec Biol 215(3):403-410 (1990).
Amour et al., "General considerations for proteolytic cascades," Biochem. Soc. (Great Britain) 32(Pt 1):15-16 (2004).
Austen et al., "The role of complement and natural antibody in intestinal ischemia reperfusion injury," Int. J. Immunopathol. Pharmacol. 16(1):1-8 (2003).
Backes et al., "Synthesis of positional-scanning libraries of fluorogenic peptide substrates to define the extended substrate specificity of plasmin and thrombin," Nat Biotechnol. 18(2):187-193 (2000).
Barrett, A., "Introduction: the classification of proteinases," Ciba Foundation Symposium 75:1-13 (1979).
BD Biosciences, "Tools to study the complement system," Chapter 13, in *Techniques for Immune Function Application Handbook*, 2$^{nd}$ Edition, BD Biosciences. pp. 249-257 (2009).
Beers et al., Chapter 163: "Biology of the immune system," Section 13: Immunology; Allergic Disorders; Merck Research Laboratories. In *The Merck Manual of Diagnosis and Therapy*, Whitehouse Station, N.J., Chapter 163:1320-1331 (2006).
Bernoist, C. and P. Chambon, "In vivo sequence requirements of the SV40 early promotor region," Nature 290:304-310 (1981).
Bhole, D. and G. Stahl, "Therapeutic potential of targeting the complement cascade in critical care medicine," Crit. Care Med. 31(1 Suppl):S97-S104 (2003).
Bock et al., "Exosites in the substrate specificity of blood coagulation reactions," J. Thromb. Haemost., 5:81-94 (2007).
Bode et al., "The refined 1.9 A crystal structure of human alpha-thrombin: interaction with D-Phe-Pro-Arg chloromethylketone and significance of the Tyr-Pro-Pro-Trp insertion segment," The EMBO Journal, 8:3467-3475 (1989).
Bork, P. and G. Beckmann, "The CUB domain: A widespread module in developmentally regulated proteins," J. Mol. Biol. 231:539-545 (1993).
Bornscheuer et al., "Improved biocatalysts by directed evolution and rational protein design," Curr. Opin. Chem. Biol. 5(2):137-143 (2001).
Bowie et al., "Deciphering the message in protein sequences: tolerance to amino acid substitutions," Science 247:1306-1310 (1990).
Brinkworth et al., "Hemoglobin-degrading, aspartic proteases of blood-feeding parasites: substrate specificity revealed by homology models," J. Biol. Chem. 276(42):38844-38851 (2001).
Brinster et al., "Regulation of metallothionein—thymidine kinase fusion plasmids injected into mouse eggs," Nature 296:39-42 (1982).
Buerke et al., "Novel small molecule inhibitor of Cls exerts cardioprotective effects in ischemia-reperfusion injury in rabbits," J. Immunol. 167:5375-5380 (2001).
Buyon et al., "Assessment of disease activity and impending flare in patients with systemic lupus erythematosus. Comparison of the use of complement split products and conventional measurements of complement," Arthritis Rheum. 35:1028-1037 (1992).
Cameron et al., "Comparison of the substrate-binding pockets of the Rous sarcoma virus and human immunodeficiency virus type 1 proteases," J. Biol. Chem. 268:11711-11720 (1993).
Cameron et al., "Mutational analysis of the substrate binding pockets of the Rous sarcoma virus and human immunodeficiency virus-1 proteases," J. Biol. Chem. 269: 11170-11177 (1994).
Carmeliet, E., "Voltage- and time-dependent block of the delayed K+ current in cardiac myocytes by dofetilide," J. Pharmacol. Exp. Ther. 262:809-817 (1992).
Carrillo, H., and D. Lipman, "The multiple sequence alignment problem in biology," SIAM J. Appl. Math. 48:1073-1082 (1988).
Cascola-Rosen et al., "Cleavage by granzyme B is strongly predictive of autoantigen status: Implications for initiation of autoimmunity," J. Exp. Med. 190(6):815-825 (1999).
Chen et al., "A residue in the S2 subsite controls substrate selectivity of matrix metalloproteinase-2 and matrix metalloproteinase-9," J Biol. Chem. 278:17158-17163 (2003).
Cooper, N., "Assays for complement activation," Clin. Lab. Med. 6(1):139-145 (1986).
Couser et al., "The effects of soluble recombinant complement receptor 1 on complement-mediated experimental glomerulonephritis," J. Am. Soc. Nephrol. 5:1888-1894 (1995).
Craik et al., "Proteases as therapeutics," Biochem. J. 435:1-16 (2011).
Craik et al., "The catalytic role of the active site aspartic acid in serine proteases," Science 237(4817):909-913 (1987).
Dang et al., "Rational engineering of activity and specificity in a serine protease," Nature Biotechnol. 15(2):146-149 (1997).
Davis, A. and R. Harrison, "Structural characterization of factor I mediated cleavage of the third component of complement," Biochem. 21:5745-5749 (1982).
DeBoer et al., "The tac promoter: a functional hybrid derived from the trp and lac promoters," Natl. Acad. Sci. U.S.A. 80:21-25 (1983).
Dementiev et al., "Canonical inhibitor-like interactions explain reactivity of alpha 1-proteinase inhibitor Pittsburgh and antithrombin with proteinases," J. Biol. Chem. 278:37881-37887 (2003).
Desilets et al., "Inhibition of human matriptase by eglin c variants." FEBS Letters 580:2227-2232 (2006).
Desilets et al., "Optimization of matriptase inhibition by eglin C variants randomized at adventitious contact points." FASEB Journal (Mar. 4, 2005) 19(4) Supp. 1. A864, Experimental Biology 2005 Meeting/35th International Congress of Physiological Sciences. San Diego, CA, USA. Mar. 31-Apr. 6, 2005.
Devereux et al., "A comprehensive set of sequence analysis programs for the VAX," Nucleic Acids Research, 12(1):387-399, (1984).
Ekdahl et al., "Inhibition of factor I by diisopropylfluorophosphate. Evidence of conformational changes in factor I induced by C3b and additional studies on the specificity of factor I," J. Immunol. 144(11):4269-4274 (1990).
Evans et al., "In vitro and in vivo inhibition of complement activity by a single-chain Fv fragment recognizing human C5," Mol. Immunol. 32(16):1183-1195 (1995).
Fletcher et al., "Virulence of a Porphyromonas gingivalis W83 mutant defective in the prtH gene," Infect. Immun. 63(4):1521-1528 (1995).
Fonseca et al., "Absence of C1q leads to less neuropathology in transgenic mouse models of Alzheimer's disease," J. Neurosci. 24(29):6457-6465, (2004).

(56) References Cited

OTHER PUBLICATIONS

Frangogiannis et al., "The inflammatory response in myocardial infarction," CardiovasRes.53(1):31-47 (2002).
Frank, M. and L. Fries, "The role of complement in inflammation and phagocytosis," Immunol. Today 12(9):322-326 (1991).
Friedrich et al., "Catalytic domain structures of MT-SP1/matriptase, a matrix-degrading transmembrane serine proteinase," J. Biol. Chem. 277(3):2160-2168 (2002).
Gaboriaud et al., "The crystal structure of the globular head of complement protein C1q provides a basis for its versatile recognition properties," J. Biol. Chem. 278(47):46974-46982 (2003).
Galkin et al., "CVS-3983, a selective matriptase inhibitor, suppresses the growth of androgen independent prostate tumor xenografts," Prostate 61(3):228-235 (2004).
Gardner et al., "The complete nucleotide sequence of an infectious clone of cauliflower mosaic virus by M13mp7 shotgun sequencing," Nucleic Acids Res. 9:2871-2888 (1981).
Gasque P., "Complement: a unique innate immune sensor for danger signals," Mol. Immunol. 41(11):1089-1098 (2004).
Gayle et al., "Identification of regions in interleukin-1α important for activity," J. Biol. Chem. 268(29):22105-22111 (1993).
Genbank Accession No. AAF00109, "Membrane-type serine protease 1 [Homo sapiens]," Published on Oct. 1, 1999 [online][retrieved on Jan. 11, 2011] Retrieved from:<URL:ncbi.nlm.nih.gov/protein/AAF00109 [3 pages].
Genbank Accession No. AAH05496, "Suppression of tumorigenicity 14 (colon carcinoma) [Mus musculus," Published on Dec. 2, 2006 [online][retrieved on Jan. 11, 2011] Retrieved from:<URL:ncbi.nlm.nih.gov/protein/AAH05496 [4 pages].
Document Genbank Accession No. AAH05826, "ST14 protein [Homo sapiens]," Published on Dec. 9, 2005.[online][ retrieved on Jan. 11, 2011] Retrieved from:<URL:ncbi.nlm.nih.gov/protein/AAH05826 [4 pages].
Genbank Accession No. AAH30532, "Suppression of tumorigenicity 14 (colon carcinoma) [Homo sapiens]," Published on Jul. 15, 2006 [online][retrieved on Jan. 11, 2011] Retrieved from:<URL:ncbi.nlm.nih.gov/protein/AAH30532 [4 pages].
Genbank Accession No. AAH97271, Suppression of tumorigenicity 14 (colon carcinoma) [Rattus norvegicus] Published on Jul. 17, 2006 [online][ retrieved on Jan. 11, 2011] Retrieved from:<URL:ncbi.nlm.nih.gov/protein/AAH97271 [4 pages].
Genbank Accession No. BAB03502, "Membrane bound serine protease [Rattus norvegicus]," Published on Oct. 20, 2001 [online][retrieved on Jan. 11, 2011] Retrieved from:<URL:ncbi.nlm.nih.gov/protein/BAB03502 [3 pages].
Genbank Accession No. BAB08218, "Homolog of human MT-SP1 [Xenopus laevis]," Published on Aug. 9, 2000 [online][ retrieved on Jan. 11, 2011] Retrieved from:<URL:ncbi.nlm.nih.gov/protein/BAB08218 [3 pages].
Genbank Accession No. JC7775, "Membrane type-serine protease 1—rat," Published on Feb. 1, 2002 [online][retrieved on Jan. 11, 2011] Retrieved from:<URL:ncbi.nlm.nih.gov/protein/25527058 [3 pages].
Gianenelli et al., "Biological and clinical significance of neutralizing and binding antibodies to interferon-alpha (IFN-alpha) during therapy for chronic hepatitis C," Clin. Exp. Immunol. 97(2):4-9 (1994).
Gilbert, W. and L. Villa-Komaroff, "Useful proteins from recombinant bacteria," Sci. Am. 242:74-94 (1980).
Graham et al., "Random mutagenesis of the substrate-binding site of a serine protease can generate enzymes with increased activities and altered primary specificities," Biochem. 32(24):6250-6258 (1993).
Greffard et al., "Determination of the complement component C2 by ELISA in human serum and bronchoalveolar lavage fluids," Immunol. Lett. 15:145-151 (1987).
Gribskov, M. and R. Burgess, "Sigma factors from E. coli, B. subtilis, phage SP01, and phage T4 are homologous proteins," Nucleic Acids Res. 14:6745-6763 (1986).

Groll et al., "Probing structural determinants distal to the site of hydrolysis that control substrate specificity of the 20S proteasome," Chem. Biol. 9:655-662 (2002).
Grosschedl et al., "Introduction of a mu immunoglobulin gene into the mouse germ line: specific expression in lymphoid cells and synthesis of functional antibody," Cell 38:647-658 (1984).
Guo, R. and P. Ward, "Role of C5a in inflammatory responses," Ann. Rev. Immunol. 23:821-852 (2005).
Guo et al., "Neutrophil C5a receptor and the outcome in a rat model of sepsis," FASEB J. 17(13):1889-1891 (2003).
Guo et al., "Protein tolerance to random amino acid change," Proc. Natl. Acad. Sci. USA 101(25):9205-9210 (2004).
Hack et al., "Elevated plasma levels of the anaphylatoxins C3a and C4a are associated with a fatal outcome in sepsis," Am. J. Med. 86:20-26 (1989).
Hammer, R., "Diversity of alpha-fetoprotein gene expression in mice is generated by a combination of separate enhancer elements," Science 235:53-58 (1987).
Hanahan, D., "Heritable formation of pancreatic beta-cell tumours in transgenic mice expressing recombinant insulin/simian virus 40 oncogenes," Nature 315:115-122 (1985).
Harris et al., "Definiton and redesign of the extended substrate specificity of granzyme B," J. Biol. Chem. 273:27364-27373 (1998).
Harris et al., "Rapid and general profiling of protease specificity by using combinatorial fluorogenic substrate libraries," Proc. Natl. Acad. Sci. U.S.A. 97(14):7754-7759 (2000).
Harrison, R. and P. Lachmann, "The physiological breakdown of the third component of human complement," Mol. Immunol. 17:9-20 (1980).
Hart et al., "Gastrointestinal ischemia-reperfusion injury is lectin complement pathway dependent without involving C1q1," J. Immunol., 174:6373-6380 (2005).
Hecke et al., "Analysis of complement proteins in polytrauma patients-correlation with injury severity, sepsis and outcome," Shock 7:74 (1997).
Heideman, M. and T. Hugli, "Anaphylatoxin generation in multisystem organ failure," J. Trauma 24:1038-1043 (1984).
Herrar-Estrella et al., "Expression of chimaeric genes transferred into plant cells using a Ti-plasmid-derived vector," Nature 303:209-213 (1984).
Herrera-Estrella et al., "Light-inducible and chloroplast-associated expression of a chimaeric gene introduced into Nicotiana tabacum using a Ti plasmid vector," Nature 310:115-120 (1984).
Herter et al., "Hepatocyte growth factor is a preferred in vitro substrate for human hepsin, a membrane-anchored serine protease implicated in prostate and ovarian cancers," Biochem. J. 390:125-136 (2005).
Holmskov et al., "Collectins: collagenous C-type lectins of the innate immune defense system," Immunol. Today 15(2):67-74 (1994).
Hopfner, K et al., "Coagulation factor IXa: the relaxed conformation of Tyr99 blocks substrate binding," Structure 7(8):989-996 (1999).
Hourcade et al., "Analysis of the short consensus repeats of human complement factor by site-directed mutagenesis," J. Biol. Chem. 270(34):19716-19722 (1995).
Hourcade et al., "The regulators of complement activation (RCA) gene cluster," Adv. Immunol. 45:381-416 (1989).
Hourcade et al., "Mutations of the type A domain of complement factor B that promote high-affinity C3b-binding," J. Immunol. 162(5):2906-2911 (1999).
Ino et al., "Effects of FUT-175, a novel synthetic protease inhibitor, on the development of adjuvant arthritis in rats and some biological reactions dependent on complement activation," Gen. Pharmacol. 18(5):513-516 (1987).
IUPAC-IUB Commission on Biochemical Nomenclature, "A one-letter notation for amino acid sequences: tentative rules," J. Biol. Chem. 243(13):3557-3559 (1968).
IUPAC-IUB Commission on Biochemical Nomenclature, "Symbols for amino-acid derivatives and peptides: recommendations (1971)," Biochem. 11(9):1726-1732 (1972).

(56) References Cited

OTHER PUBLICATIONS

Jay et al., "Construction of a general vector for efficient expression of mammalian proteins in bacteria: use of a synthetic ribosome binding site," Proc. Natl. Acad. Sci. U.S.A. 78:5543-5548 (1981).
Jing et al., "New structural motifs on the chymotrypsin fold and their potential roles in complement factor B," The EMBO Journal 19:164-173 (2000).
Kai et al., "Mouse C3b/C4b inactivator: purification and properties," J. Immunol. 125:2409-2415 (1980).
Kavanagh et al., "Mutations in complement factor I predispose to development of atypical hemolytic uremic syndrome," J. Am. Soc. Nephrol. 16(7):2150-2155 (2005).
Ke et al., "Distinguishing the specificities of closely related proteases. Role of P3 in substrate and inhibitor discrimination between tissue-type plasminogen activator and urokinase," J. Biol. Chem. 272(26):16603-16609 (1997).
Kelsey et al., "Species- and tissue-specific expression of human alpha 1-antitrypsin in transgenic mice," Genes Dev. 1:161-171 (1987).
Ketner et al., "Efficient manipulation of the human adenovirus genome as an infectious yeast artificial chromosome clone," Proc. Natl. Acad. Sci. U.S.A. 91: 6186-6190 (1994).
Kilgore et al., "The semisynthetic polysaccharide pentosan polysulfate prevents complement-mediated myocardial injury in the rabbit perfused heart," J. Pharmacol. Exp. Ther. 285:987-994.
Kirschfink et al., "Modern complement analysis," Clin. Diag. Lab. Immunol. 10(6):982-989 (2003).
Kollias et al., "Regulated expression of human A gamma-, beta-, and hybrid gamma beta-globin genes in transgenic mice: manipulation of the developmental expression patterns," Cell 46:89-94.
Krumlauf et al., "Developmental regulation of alpha-fetoprotein genes in transgenic mice," Mol. Cell. Biol. 5:1639-1648 (1985).
Lambris et al., "Dissection of CR1, factor H, membrane cofactor protein, and factor B binding and functional sites in the third complement component," J. Immunol. 156(12):4821-4832 (1996).
Lawrence et al., "Serpin-protease complexes are trapped as stable acyl-enzyme intermediates," J. Biol. Chem. 270(43):25309-25312 (1995).
Leder et al., "Consequences of widespread deregulation of the c-myc gene in transgenic mice: multiple neoplasms and normal development," Cell 45:485-495 (1986).
Lien et al., "Combinatorial strategies for the discovery of novel protease specificities," Comb. Chem. High Throughput Screening 2:73-90 (1999).
Lin et al., "Molecular cloning of cDNA for matriptase, a matrix-degrading serine protease with tryspin-like activity," J. Biol. Chem. 274:18231-18236 (1999).
Lin et al., "A novel human dendritic cell-derived Clr-like serine protease analog inhibits complement-mediated cytotoxicity," Biochem. Biophys. Res. Comm. 321(2):329-336 (2004).
Lindenbaum et al., "A mammalian artificial chromosome engineering system (ACE System) applicable to biopharmaceutical protein production, transgenesis and gene-based cell therapy," Nucleic Acids Res. 32(21):e172 (2004).
Liu et al., "Human m-ficolin is a secretory protein that activates the lectin complement pathway," J. Immunol. 175:3150-3156 (2005).
Macdonald, R., "Expression of the pancreatic elastese I gene in transgenic mice," Hepatol. 7(S1):42S-51S (1987).
Mackman et al., "Exploiting subsite S1 of trypsin-like serine proteases for selectivity: potent and selective inhibitors of urokinase-type plasminogen activator," J. Med. Chem. 44(23):3856-3871.
Madison et al., "Amino acid residues that affect interaction of tissue-type plasminogen activator with plasminogen activator inhibitor 1," Proc. Natl. Acad. Sci. U.S.A. 87:3530-3533 (1990).
Madison et al., "Converting tissue plasminogen activator to a zymogen: a regulatory triad of Asp-His-Ser," Science, 262:419-421 (1993).
Magram et al., "Developmental regulation of a cloned adult beta-globin gene in transgenic mice," Nature 315:338-340 (1985).
Malhotra et al., "Collectins, collectin receptors and the lectin pathway of complement activation," Clin Exp Immunol. 97(Suppl 2):4-9 (1994).
Manzetti et al., "Modeling of enzyme-substrate complexes for the metalloproteases MMP-3, ADAM-9 and ADAM-10," J. Comput. Aid. Mol. Des. 17:551-565 (2003).
Mason et al., "The hypogonadal mouse:reproductive functions restored by gene therapy," Science 234:1372-1378 (1986).
Mastellos et al., "Complement: an inflammatory pathway fulfilling multiple roles at the interface of innate immunity and development," Curr. Drug Targets—Inflamm. Allerg. 4(1):125-127 (2005).
Mayer, G., "Complement," Microbiology and Immunology On-line, University of South Carolina, Immunology: Chapter 2, Published on Sep. 11, 2006 [online][retrieved on Feb. 26, 2007] Retrieved from:<pathmicro.med.sc.edu/ghaffar/complement.htm [8 pages].
Mayes et al., "Development and application of an enzyme-linked immunosorbent assay for the quantitation of alternative complement pathway activation in human serum," J. Clin. Invest. 73:160-170 (1984).
Mayfield et al., "Expression and assembly of a fully active antibody in algae," et al., Proc. Natl. Acad. Sci. U.S.A. 100:438-442 (2003).
McGeer, P. and E. McGeer, "Inflammation of the brain in Alzheimer's disease: implications for therapy," J Leukoc Biol. 65(4):409-415 (1999).
McGeer, P. and E. McGeer, "The possible role of complement activation in Alzheimer disease," Trends Mol. Med. 8(11):519-523 (2002).
Mead et al., "The membrane attack complex of complement causes severe demyelination associated with acute axonal injury," J. Immunol. 168(1):458-465 (2002).
Mizuno et al., "Soluble complement receptor type 1 protects rats from lethal shock induced by anti-Crry antibody following lipopolysaccharide priming," Int. Arch. Allergy Immunol. 127(1):55-62 (2002).
Mocco et al., "Complement component C3 mediates inflammatory injury following focal cerebral ischemia," Circ. Res 99:209-217 (2006).
Morgan, B. and C. Harris, "Complement therapeutics; history and current progress," Mol. Immunol. 40(2-4):159-170 (2003).
Moxley, G. and S. Ruddy, "Elevated plasma C3 anaphylatoxin levels in rheumatoid arthritis patients," Arthrit. Rheum. 30:1097-1104 (1987).
Nagaki et al., "A new method for the preparation of EAC14 cell with human or guinea-pig serum," J. Immunol. Meth. 5:307-317 (1974).
NCBI Nucleotide AB048796 (accessed on Feb. 27, 2007) [online].
NCBI Nucleotide AC005570 (Cosmid 407D8) (accessed on Feb. 27, 2007) [online].
NCBI Nucleotide AF064819 (accessed on Feb. 27, 2007) [online].
NCBI Nucleotide AF118224 (accessed on Feb. 27, 2007) [online].
NCBI Nucleotide AF284421 (accessed on Feb. 27, 2007) [online].
NCBI Nucleotide AJ007331 (accessed on Feb. 27, 2007) [online].
NCBI Nucleotide AK075142 (accessed on Feb. 27, 2007) [online].
NCBI Nucleotide AL136097 (RP11-62C3 clone) (accessed on Feb. 27, 2007) [online].
NCBI Nucleotide BC035384 (accessed on Feb. 27, 2007) [online].
NCBI Nucleotide BC036846 (accessed on Feb. 27, 2007) [online].
NCBI Nucleotide BC041609 (accessed on Feb. 27, 2007) [online].
NCBI Nucleotide BC048112 (accessed on Feb. 27, 2007) [online].
NCBI Nucleotide BN000120 (accessed on Feb. 27, 2007) [online].
NCBI Nucleotide BN000128 (accessed on Feb. 27, 2007) [online].
NCBI Nucleotide BN000133 (accessed on Feb. 27, 2007) [online].
NCBI Nucleotide M14221 (accessed on Feb. 27, 2007) [online].
NCBI Nucleotide M15203 (accessed on Feb. 27, 2007) [online].
NCBI Nucleotide M16652 (accessed on Feb. 27, 2007) [online].
NCBI Nucleotide M17016 (accessed on Feb. 27, 2007) [online].
NCBI Nucleotide M24400 (accessed on Feb. 27, 2007) [online].
NCBI Nucleotide M84342 (accessed on Feb. 27, 2007) [online].
NCBI Nucleotide NM_000128 (accessed on Feb. 27, 2007) [online].
NCBI Nucleotide NM_000131 (accessed on Feb. 27, 2007) [online].
NCBI Nucleotide NM_000133 (accessed on Feb. 27, 2007) [online].

(56) References Cited

OTHER PUBLICATIONS

NCBI Nucleotide NM_000301 (accessed on Feb. 27, 2007) [online].
NCBI Nucleotide NM_000312 (accessed on Feb. 27, 2007) [online].
NCBI Nucleotide NM_000504 (accessed on Feb. 27, 2007) [online].
NCBI Nucleotide NM_000505 (accessed on Feb. 27, 2007) [online].
NCBI Nucleotide NM_000506 (accessed on Feb. 27, 2007) [online].
NCBI Nucleotide NM_000892 (accessed on Feb. 27, 2007) [online].
NCBI Nucleotide NM_000930 (accessed on Feb. 27, 2007) [online].
NCBI Nucleotide NM_000931 (accessed on Feb. 27, 2007) [online].
NCBI Nucleotide NM_001002231 (accessed on Feb. 27, 2007) [online].
NCBI Nucleotide NM_001002232 (accessed on Feb. 27, 2007) [online].
NCBI Nucleotide NM_001012964 (accessed on Feb. 27, 2007) [online].
NCBI Nucleotide NM_001012965 (accessed on Feb. 27, 2007) [online].
NCBI Nucleotide NM_001012966 (accessed on Feb. 27, 2007) [online].
NCBI Nucleotide NM_001030047 (accessed on Feb. 27, 2007) [online].
NCBI Nucleotide NM_001030048 (accessed on Feb. 27, 2007) [online].
NCBI Nucleotide NM_001030049 (accessed on Feb. 27, 2007) [online].
NCBI Nucleotide NM_001030050 (accessed on Feb. 27, 2007) [online].
NCBI Nucleotide NM_001097 (accessed on Feb. 27, 2007) [online].
NCBI Nucleotide NM_001528 (accessed on Feb. 27, 2007) [online].
NCBI Nucleotide NM_001648 (accessed on Feb. 27, 2007) [online].
NCBI Nucleotide NM_001836 (accessed on Feb. 27, 2007) [online].
NCBI Nucleotide NM_001907 (accessed on Feb. 27, 2007) [online].
NCBI Nucleotide NM_001911 (accessed on Feb. 27, 2007) [online].
NCBI Nucleotide NM_001971 (accessed on Feb. 27, 2007) [online].
NCBI Nucleotide NM_001972 (accessed on Feb. 27, 2007) [online].
NCBI Nucleotide NM_002104 (accessed on Feb. 27, 2007) [online].
NCBI Nucleotide NM_002151 (accessed on Feb. 27, 2007) [online].
NCBI Nucleotide NM_002257 (accessed on Feb. 27, 2007) [online].
NCBI Nucleotide NM_002658 (accessed on Feb. 27, 2007) [online].
NCBI Nucleotide NM_002769 (accessed on Feb. 27, 2007) [online].
NCBI Nucleotide NM_002770 (accessed on Feb. 27, 2007) [online].
NCBI Nucleotide NM_002771 (accessed on Feb. 27, 2007) [online].
NCBI Nucleotide NM_002772 (accessed on Feb. 27, 2007) [online].
NCBI Nucleotide NM_002773 (accessed on Feb. 27, 2007) [online].
NCBI Nucleotide NM_002774 (accessed on Feb. 27, 2007) [online].
NCBI Nucleotide NM_002776 (accessed on Feb. 27, 2007) [online].
NCBI Nucleotide NM_002777 (accessed on Feb. 27, 2007) [online].
NCBI Nucleotide NM_003294 (accessed on Feb. 27, 2007) [online].
NCBI Nucleotide NM_003619 (accessed on Feb. 27, 2007) [online].
NCBI Nucleotide NM_003816 (accessed on Feb. 27, 2007) [online].
NCBI Nucleotide NM_004132 (accessed on Feb. 27, 2007) [online].
NCBI Nucleotide NM_004262 (accessed on Feb. 27, 2007) [online].
NCBI Nucleotide NM_004917 (accessed on Feb. 27, 2007) [online].
NCBI Nucleotide NM_005046 (accessed on Feb. 27, 2007) [online].
NCBI Nucleotide NM_005317 (accessed on Feb. 27, 2007) [online].
NCBI Nucleotide NM_005551 (accessed on Feb. 27, 2007) [online].
NCBI Nucleotide NM_005656 (accessed on Feb. 27, 2007) [online].
NCBI Nucleotide NM_005747 (accessed on Feb. 27, 2007) [online].
NCBI Nucleotide NM_006144 (accessed on Feb. 27, 2007) [online].
NCBI Nucleotide NM_006587 (accessed on Feb. 27, 2007) [online].
NCBI Nucleotide NM_006799 (accessed on Feb. 27, 2007) [online].
NCBI Nucleotide NM_006853 (accessed on Feb. 27, 2007) [online].
NCBI Nucleotide NM_007173 (accessed on Feb. 27, 2007) [online].
NCBI Nucleotide NM_007196 (accessed on Feb. 27, 2007) [online].
NCBI Nucleotide NM_007272 (accessed on Feb. 27, 2007) [online].
NCBI Nucleotide NM_007352 (accessed on Feb. 27, 2007) [online].
NCBI Nucleotide NM_012217 (accessed on Feb. 27, 2007) [online].
NCBI Nucleotide NM_012315 (accessed on Feb. 27, 2007) [online].
NCBI Nucleotide NM_012427 (accessed on Feb. 27, 2007) [online].
NCBI Nucleotide NM_012467 (accessed on Feb. 27, 2007) [online].
NCBI Nucleotide NM_015596 (accessed on Feb. 27, 2007) [online].
NCBI Nucleotide NM_015849 (accessed on Feb. 27, 2007) [online].
NCBI Nucleotide NM_017509 (accessed on Feb. 27, 2007) [online].
NCBI Nucleotide NM_019559 (accessed on Feb. 27, 2007) [online].
NCBI Nucleotide NM_019598 (accessed on Feb. 27, 2007) [online].
NCBI Nucleotide NM_019616 (accessed on Feb. 27, 2007) [online].
NCBI Nucleotide NM_019894 (accessed on Feb. 27, 2007) [online].
NCBI Nucleotide NM_022046 (accessed on Feb. 27, 2007) [online].
NCBI Nucleotide NM_022119 (accessed on Feb. 27, 2007) [online].
NCBI Nucleotide NM_023006 (accessed on Feb. 27, 2007) [online].

(56) References Cited

OTHER PUBLICATIONS

NCBI Nucleotide NM_024022 (accessed on Feb. 27, 2007) [online].
NCBI Nucleotide NM_024164 (accessed on Feb. 27, 2007) [online].
NCBI Nucleotide NM_030770 (accessed on Feb. 27, 2007) [online].
NCBI Nucleotide NM_031948 (accessed on Feb. 27, 2007) [online].
NCBI Nucleotide NM_032401 (accessed on Feb. 27, 2007) [online].
NCBI Nucleotide NM_032404 (accessed on Feb. 27, 2007) [online].
NCBI Nucleotide NM_032405 (accessed on Feb. 27, 2007) [online].
NCBI Nucleotide NM_033011 (accessed on Feb. 27, 2007) [online].
NCBI Nucleotide NM_033423 (accessed on Feb. 27, 2007) [online].
NCBI Nucleotide NM_138563 (accessed on Feb. 27, 2007) [online].
NCBI Nucleotide NM_138564 (accessed on Feb. 27, 2007) [online].
NCBI Nucleotide NM_139277 (accessed on Feb. 27, 2007) [online].
NCBI Nucleotide NM_144505 (accessed on Feb. 27, 2007) [online].
NCBI Nucleotide NM_144506 (accessed on Feb. 27, 2007) [online].
NCBI Nucleotide NM_144507 (accessed on Feb. 27, 2007) [online].
NCBI Nucleotide NM_144947 (accessed on Feb. 27, 2007) [online].
NCBI Nucleotide NM_144956 (accessed on Feb. 27, 2007) [online].
NCBI Nucleotide NM_144957 (accessed on Feb. 27, 2007) [online].
NCBI Nucleotide NM_145888 (accessed on Feb. 27, 2007) [online].
NCBI Nucleotide NM_145894 (accessed on Feb. 27, 2007) [online].
NCBI Nucleotide NM_145895 (accessed on Feb. 27, 2007) [online].
NCBI Nucleotide NM_153609 (accessed on Feb. 27, 2007) [online].
NCBI Nucleotide NM_182983 (accessed on Feb. 27, 2007) [online].
NCBI Nucleotide NM_183062 (accessed on Feb. 27, 2007) [online].
NCBI Nucleotide NM_183247 (accessed on Feb. 27, 2007) [online].
NCBI Nucleotide NM_198464 (accessed on Feb. 27, 2007) [online].
NCBI Nucleotide S93414 (accessed on Feb. 27, 2007) [online].
NCBI Nucleotide U13665 (accessed on Feb. 27, 2007) [online].
NCBI Nucleotide X05232 (accessed on Feb. 27, 2007) [online].
NCBI Nucleotide Y14734 (accessed on Feb. 27, 2007) [online].
NCBI Protein AAA52380 (accessed on Feb. 28, 2007) [online].
NCBI Protein AAC80208 (accessed on Feb. 28, 2007) [online].
NCBI Protein AAD42765 (accessed on Feb. 28, 2007) [online].
NCBI Protein AAF04328 (accessed on Feb. 28, 2007) [online].
NCBI Protein AAH35384 (accessed on Feb. 28, 2007) [online].
NCBI Protein AAH41609 (accessed on Feb. 28, 2007) [online].
NCBI Protein AAH48112 (accessed on Feb. 28, 2007) [online].
NCBI Protein AAK84071 (accessed on Feb. 28, 2007) [online].
NCBI Protein AAN04055 (accessed on Feb. 28, 2007) [online].
NCBI Protein BAB39741 (accessed on Feb. 28, 2007) [online].
NCBI Protein BAC11431 (accessed on Feb. 28, 2007) [online].
NCBI Protein CAA28859.1 (accessed on Feb. 28, 2007) [online].
NCBI Protein CAC12709 (accessed on Feb. 28, 2007) [online].
NCBI Protein CAD66452 (accessed on Feb. 28, 2007) [online].
NCBI Protein CAD67579 (accessed on Feb. 28, 2007) [online].
NCBI Protein CAD67985 (accessed on Feb. 28, 2007) [online].
NCBI Protein NP_000119 (accessed on Feb. 28, 2007) [online].
NCBI Protein NP_000122 (accessed on Feb. 28, 2007) [online].
NCBI Protein NP_000124 (accessed on Feb. 28, 2007) [online].
NCBI Protein NP_000292 (accessed on Feb. 28, 2007) [online].
NCBI Protein NP_000303 (accessed on Feb. 28, 2007) [online].
NCBI Protein NP_000495 (accessed on Feb. 28, 2007) [online].
NCBI Protein NP_000496 (accessed on Feb. 28, 2007) [online].
NCBI Protein NP_000497 (accessed on Feb. 28, 2007) [online].
NCBI Protein NP_000883 (accessed on Feb. 28, 2007) [online].
NCBI Protein NP_000921 (accessed on Feb. 28, 2007) [online].
NCBI Protein NP_000922 (accessed on Feb. 28, 2007) [online].
NCBI Protein NP_001002231 (accessed on Feb. 28, 2007) [online].
NCBI Protein NP_001002232 (accessed on Feb. 28, 2007) [online].
NCBI Protein NP_001012982 (accessed on Feb. 28, 2007) [online].
NCBI Protein NP_001012983 (accessed on Feb. 28, 2007) [online].
NCBI Protein NP_001012984 (accessed on Feb. 28, 2007) [online].
NCBI Protein NP_001025218 (accessed on Feb. 28, 2007) [online].
NCBI Protein NP_001025219 (accessed on Feb. 28, 2007) [online].
NCBI Protein NP_001025220 (accessed on Feb. 28, 2007) [online].
NCBI Protein NP_001025221 (accessed on Feb. 28, 2007) [online].
NCBI Protein NP_001088 (accessed on Feb. 28, 2007) [online].
NCBI Protein NP_001101 (accessed on Feb. 28, 2007) [online].
NCBI Protein NP_001519 (accessed on Feb. 28, 2007) [online].
NCBI Protein NP_001639 (accessed on Feb. 28, 2007) [online].
NCBI Protein NP_001827 (accessed on Feb. 28, 2007) [online].
NCBI Protein NP_001898 (accessed on Feb. 28, 2007) [online].
NCBI Protein NP_001902 (accessed on Feb. 28, 2007) [online].
NCBI Protein NP_001962 (accessed on Feb. 28, 2007) [online].
NCBI Protein NP_001963 (accessed on Feb. 28, 2007) [online].
NCBI Protein NP_002095 (accessed on Feb. 28, 2007) [online].
NCBI Protein NP_002142 (accessed on Feb. 28, 2007) [online].
NCBI Protein NP_002248 (accessed on Feb. 28, 2007) [online].
NCBI Protein NP_002649 (accessed on Feb. 28, 2007) [online].
NCBI Protein NP_002760 (accessed on Feb. 28, 2007) [online].
NCBI Protein NP_002761 (accessed on Feb. 28, 2007) [online].
NCBI Protein NP_002762 (accessed on Feb. 28, 2007) [online].
NCBI Protein NP_002763 (accessed on Feb. 28, 2007) [online].
NCBI Protein NP_002764 (accessed on Feb. 28, 2007) [online].
NCBI Protein NP_002765 (accessed on Feb. 28, 2007) [online].
NCBI Protein NP_002767 (accessed on Feb. 28, 2007) [online].
NCBI Protein NP_002768 (accessed on Feb. 28, 2007) [online].
NCBI Protein NP_003285 (accessed on Feb. 28, 2007) [online].
NCBI Protein NP_003610 (accessed on Feb. 28, 2007) [online].
NCBI Protein NP_003807 (accessed on Feb. 28, 2007) [online].
NCBI Protein NP_004123 (accessed on Feb. 28, 2007) [online].
NCBI Protein NP_004253 (accessed on Feb. 28, 2007) [online].
NCBI Protein NP_004908 (accessed on Feb. 28, 2007) [online].
NCBI Protein NP_005037 (accessed on Feb. 28, 2007) [online].
NCBI Protein NP_005308 (accessed on Feb. 28, 2007) [online].
NCBI Protein NP_005542 (accessed on Feb. 28, 2007) [online].
NCBI Protein NP_005647 (accessed on Feb. 28, 2007) [online].
NCBI Protein NP_005738 (accessed on Feb. 28, 2007) [online].
NCBI Protein NP_006135 (accessed on Feb. 28, 2007) [online].
NCBI Protein NP_006578 (accessed on Feb. 28, 2007) [online].
NCBI Protein NP_006790 (accessed on Feb. 28, 2007) [online].
NCBI Protein NP_006844 (accessed on Feb. 28, 2007) [online].
NCBI Protein NP_009104 (accessed on Feb. 28, 2007) [online].
NCBI Protein NP_009127 (accessed on Feb. 28, 2007) [online].
NCBI Protein NP_009203 (accessed on Feb. 28, 2007) [online].
NCBI Protein NP_031378 (accessed on Feb. 28, 2007) [online].
NCBI Protein NP_036349 (accessed on Feb. 28, 2007) [online].
NCBI Protein NP_036447 (accessed on Feb. 28, 2007) [online].
NCBI Protein NP_036559 (accessed on Feb. 28, 2007) [online].
NCBI Protein NP_056411 (accessed on Feb. 28, 2007) [online].
NCBI Protein NP_056933 (accessed on Feb. 28, 2007) [online].
NCBI Protein NP_059979 (accessed on Feb. 28, 2007) [online].
NCBI Protein NP_062505 (accessed on Feb. 28, 2007) [online].
NCBI Protein NP_062544 (accessed on Feb. 28, 2007) [online].
NCBI Protein NP_062562 (accessed on Feb. 28, 2007) [online].
NCBI Protein NP_063947 (accessed on Feb. 28, 2007) [online].

(56) References Cited

OTHER PUBLICATIONS

NCBI Protein NP_071329 (accessed on Feb. 28, 2007) [online].
NCBI Protein NP_071402 (accessed on Feb. 28, 2007) [online].
NCBI Protein NP_075382 (accessed on Feb. 28, 2007) [online].
NCBI Protein NP_076927 (accessed on Feb. 28, 2007) [online].
NCBI Protein NP_077078 (accessed on Feb. 28, 2007) [online].
NCBI Protein NP_110397 (accessed on Feb. 28, 2007) [online].
NCBI Protein NP_114154 (accessed on Feb. 28, 2007) [online].
NCBI Protein NP_115777 (accessed on Feb. 28, 2007) [online].
NCBI Protein NP_115780 (accessed on Feb. 28, 2007) [online].
NCBI Protein NP_115781 (accessed on Feb. 28, 2007) [online].
NCBI Protein NP_127509 (accessed on Feb. 28, 2007) [online].
NCBI Protein NP_219491 (accessed on Feb. 28, 2007) [online].
NCBI Protein NP_612630 (accessed on Feb. 28, 2007) [online].
NCBI Protein NP_612631 (accessed on Feb. 28, 2007) [online].
NCBI Protein NP_644806 (accessed on Feb. 28, 2007) [online].
NCBI Protein NP_653088 (accessed on Feb. 28, 2007) [online].
NCBI Protein NP_653089 (accessed on Feb. 28, 2007) [online].
NCBI Protein NP_653090 (accessed on Feb. 28, 2007) [online].
NCBI Protein NP_659196 (accessed on Feb. 28, 2007) [online].
NCBI Protein NP_659205 (accessed on Feb. 28, 2007) [online].
NCBI Protein NP_659206 (accessed on Feb. 28, 2007) [online].
NCBI Protein NP_665895 (accessed on Feb. 28, 2007) [online].
NCBI Protein NP_665901 (accessed on Feb. 28, 2007) [online].
NCBI Protein NP_665902 (accessed on Feb. 28, 2007) [online].
NCBI Protein NP_705837 (accessed on Feb. 28, 2007) [online].
NCBI Protein NP_892028 (accessed on Feb. 28, 2007) [online].
NCBI Protein NP_898885 (accessed on Feb. 28, 2007) [online].
NCBI Protein NP_899070 (accessed on Feb. 28, 2007) [online].
NCBI Protein NP_940866 (accessed on Feb. 28, 2007) [online].
NCBI Protein O00187 (accessed on Feb. 28, 2007) [online].
NCBI Protein O00602 (accessed on Feb. 28, 2007) [online].
NCBI Protein O60911 (accessed on Feb. 28, 2007) [online].
NCBI Protein O75636 (accessed on Feb. 28, 2007) [online].
NCBI Protein P00736 (accessed on Feb. 28, 2007) [online].
NCBI Protein P00746 (accessed on Feb. 28, 2007) [online].
NCBI Protein P00751 (accessed on Feb. 28, 2007) [online].
NCBI Protein P00784 (accessed on Feb. 28, 2007) [online].
NCBI Protein P01024 (accessed on Feb. 28, 2007) [online].
NCBI Protein P01028 (accessed on Feb. 28, 2007) [online].
NCBI Protein P01031 (accessed on Feb. 28, 2007) [online].
NCBI Protein P02745 (accessed on Feb. 28, 2007) [online].
NCBI Protein P02746 (accessed on Feb. 28, 2007) [online].
NCBI Protein P02747 (accessed on Feb. 28, 2007) [online].
NCBI Protein P02748 (accessed on Feb. 28, 2007) [online].
NCBI Protein P03322 (aa 578-701) (accessed on Feb. 28, 2007) [online].
NCBI Protein P03366 (aa 500-598) (accessed on Feb. 28, 2007) [online].
NCBI Protein P04003 (accessed on Feb. 28, 2007) [online].
NCBI Protein P05155 (accessed on Feb. 28, 2007) [online].
NCBI Protein P05156 (accessed on Feb. 28, 2007) [online].
NCBI Protein P06681 (accessed on Feb. 28, 2007) [online].
NCBI Protein P07357 (accessed on Feb. 28, 2007) [online].
NCBI Protein P07358 (accessed on Feb. 28, 2007) [online].
NCBI Protein P07360 (accessed on Feb. 28, 2007) [online].
NCBI Protein P07711 (accessed on Feb. 28, 2007) [online].
NCBI Protein P07858 (accessed on Feb. 28, 2007) [online].
NCBI Protein P08174 (accessed on Feb. 28, 2007) [online].
NCBI Protein P08603 (accessed on Feb. 28, 2007) [online].
NCBI Protein P09871 (accessed on Feb. 28, 2007) [online].
NCBI Protein P10144 (accessed on Feb. 28, 2007) [online].
NCBI Protein P10643 (accessed on Feb. 28, 2007) [online].
NCBI Protein P10909 (accessed on Feb. 28, 2007) [online].
NCBI Protein P11226 (accessed on Feb. 28, 2007) [online].
NCBI Protein P13671 (accessed on Feb. 28, 2007) [online].
NCBI Protein P15529 (accessed on Feb. 28, 2007) [online].
NCBI Protein P17538 (accessed on Feb. 28, 2007) [online].
NCBI Protein P17927 (accessed on Feb. 28, 2007) [online].
NCBI Protein P20023 (accessed on Feb. 28, 2007) [online].
NCBI Protein P20851 (accessed on Feb. 28, 2007) [online].
NCBI Protein P25774 (accessed on Feb. 28, 2007) [online].
NCBI Protein P25779 (accessed on Feb. 28, 2007) [online].
NCBI Protein P27918 (accessed on Feb. 28, 2007) [online].
NCBI Protein P34168 (accessed on Feb. 28, 2007) [online].
NCBI Protein P43235 (accessed on Feb. 28, 2007) [online].
NCBI Protein P48740 (accessed on Feb. 28, 2007) [online].
NCBI Protein Q15485 (accessed on Feb. 28, 2007) [online].
NCBI Protein Q9UBX1 (accessed on Feb. 28, 2007) [online].
Needleman, S. and C. Wunsch, "A general method applicable to the search for similarities in the amino acid sequence of two proteins," J. Mol. Biol. 48:443-453 (1970).
Netzel-Arnett et al., "Membrane anchored serine proteases: a rapidly expanding group of cell surface proteolytic enzymes with potential roles in cancer," Cancer Metast. Rev. 22(2-3):237-258 (2003).
Nogrady, T., "Pro-drugs and soft drugs," in *Medicinal Chemistry A Biochemical Approach*, Oxford University Press, New York, pp. 388-392 (1985).
Oberst et al., "The activation of matriptase requires its noncatalytic domains, serine protease domain, and its cognate inhibitor," J. Biol. Chem. 278(29):26773-26779 (2003).
Ogata et al., "Active sites in complement component C3 mapped by mutations at indels," J. Immunol. 161(9):4785-4794 (1998).
Opperman et al., "Assessment of complement activation in vivo," Immunopharmacol. 24:119-134 (1992).
Ornitz et al., "Elastase I promoter directs expression of human growth hormone and SV40 T antigen genes to pancreatic acinar cells in transgenic mice," Cold Spring Harbor Symposia on Quantitative Biology : proceedings 50:399-409 (1986).
Ostresh et al., "Peptide libraries: determination of relative reaction rates of protected amino acids in competitive couplings," Biopol. 34:1681 (1994).
Otlewski et al. "The many faces of protease-protein inhibitor interaction," EMBO Journal 24:1303-1310 (2005).
Overall, C., "Molecular determinants of metalloproteinase substrate specificity: matrix metalloproteinase substrate binding domains, modules, and exosites," Mol. Biotechnol. 22:51-86 (2002).
Pearson, W. and D. Lipman, "Improved tools for biological sequence comparison," Proc. Natl. Acad. Sci. U.S.A. 85:2444-2448 (1988).
Pekna et al., "Evidence for iC3 generation during cardiopulmonary bypass as the result of blood-gas interaction," Clin. Exp. Immunol. 91(3):404-409 (1993).
Petersen et al., "An assay for the mannan-binding lectin pathway of complement activation," J. Immunol. Meth. 257(1-2):107-116 (2001).
Pham et al., "Large-scale transient transfection of serum-free suspension-growing HEK293 EBNA1 cells: peptone additives improve cell growth and transfection efficiency," Biotechnol. Bioeng. 84:332-342 (2003).
Piddlesden et al., "Soluble recombinant complement receptor 1 inhibits inflammation and demyelination in antibody-mediated demyelinating experimental allergic encephalomyelitis," J. Immunol. 152(11):5477-5484 (1994).
Pinckert et al., "An albumin enhancer located 10 kb upstream functions along with its promoter to direct efficient, liver-specific expression in transgenic mice," Genes Dev. 1:268-276 (1987).
Porcel et al., "Methods for assessing complement activation in the clinical immunology laboratory," J. Immunol. Methods 157:1-9 (1993).
Rawlings, N. and A. Barrett, "Families of cysteine peptidases," Methods Enzymol. 244:461-486 (1994).
Rawlings, N. and A. Barrett, "Families of aspartic peptidases and those of unknown catalytic mechanism," Methods Enzymol. 248:105-120 (1994).
Rawlings, N. and A. Barrett, "Evolutionary families of metallopepidases," Methods Enzymol. 248:183-228 (1994).
Rawlings, N. and A. Barrett, "Families of serine peptidases," Methods Enzymol. 244:19-61 (1994).
Readhead et al., "Expression of a myelin basic protein gene in transgenic shiverer mice: correction of the dysmyelinating phenotype," Cell 48:703-712 (1987).

(56) References Cited

OTHER PUBLICATIONS

Riedemann et al., "Increased C5a receptor expression in sepsis," J. Clin. Invest. 110(1):101-108 (2002).
Riedemann et al., "The enigma of sepsis," J. Clin. Invest. 112(4):460-467 (2003).
Rinder et al., "Blockade of C5a and C5b-9 generation inhibits leukocyte and platelet activation during extracorporeal circulation," J. Clin. Invest. 96(3):1564-1572 (1995).
Rotonda et al., "The three-dimensional structure of human granzyme B compared to caspase-3, key mediators of cell death with cleavage specificity for aspartic acid in PI," Chem. Biol. 8(4):357-368 (2001).
Ruddy et al., "The complement system in rheumatoid synovitis," Arthritis and Rhematism 13(6):713-723 (1970).
Satomi et al. "A role for membrane-type serine proteases (MT-SP1) in intestinal epithelial turnover," Biochem. Biophys. Res. Comm. 287:995-1002 (2001).
Schecter, I. and A. Berger, "On the size of the active site in proteases. I., Papain," Biochem. Biophys. Res. Comm. 27:157-162 (1967).
Schwartz, R. and M. Dayhoff, eds., "Matrices for detecting distant relationships," in *Atlas of a Protein Sequence and Structure*, National Biomedical Research Foundation, pp. 353-358 (1979).
Seelen et al., "Functional analysis of the classical, alternative, and MBL pathways of the complement system: standardization and validation of a simple ELISA," J. Immunol. Methods 296:187-198 (2005).
Shani, M., "Tissue-specific expression of rat myosin light-chain 2 gene in transgenic mice," Nature 314:283-286 (1985).
Silverman, G. and D. Carson, "Roles of B cells in rheumatoid arthritis." Arthritis Res. Ther. 5(Suppl. 4):S1-S6 (2003).
Smith, T. and M. Waterman, "Comparison of biosequences," Advances in Applied Mathematics 2:482-489 (1981).
Smith et al., "Direct selection for sequences encoding proteases of known specificity," Proc. Natl. Acad. Sci. U.S.A. 88:5159-5162 (1991).
Solivan et al., "Evidence for diversity of substrate specificity among members of the chymase family of serine proteases," FEBS Lett. 512(1-3):133-138 (2002).
Spatola, A., "Peptide backbone modifications," in *Chemistry and Biochemistry of Amino Acids, Peptides, and Proteins*, Weinstein, B., Ed. volume 7, Marcel Dekker, New York, pp. 267-357 (1983).
Stevens et al., "Effects of anti-C5a antibodies on the adult respiratory distress syndrome in septic primates," J. Clin. Invest. 77(6):1812-1816 (1986).
Stoop et al., "Engineering of a macromolecular scaffold to develop specific protease inhibitors," Nature Biotechnol. 21(9):1063-1068 (2003).
Stove et al., "Circulating complement proteins in patients with sepsis or systemic inflammatory response syndrome," Clin. Diagn. Lab. Immunol. 3:175-183 (1996).
Swift et al., "Tissue-specific expression of the rat pancreatic elatese I gene in transgenic mice," Cell 38:639-646 (1984).
Szalai et al., "The Arthus reaction in rodents: species-specific requirement of complement," J. Immunol. 164(1):463-468 (2000).
Takematsu, H. and H. Tagami, "Complement fragment C4d and Bb levels in inflammatory skin diseases (e.g. SLE, atopic dermatitis, erythroderma and pustulosis palmaris et plantaris) for assessment of complement activation," Tohoku J. Exp. Med. 163(4):263-268 (1991).
Takeuchi et al., "Reverse biochemistry: use of macromolecular protease inhibitors to dissect complex biological processes and identify a membrane-type serine protease in epithelial cancer and normal tissue," Proc. Natl. Acad. Sci. U.S.A. 96:11054-1161 (1999).
Takeuchi et al., "Cellular localization of membrane-type serine protease 1 and identification of protease-activated receptor-2 and single-chain urokinase-type plasminogen activator as substrates," J. Biol. Chem. 275(34):26333-26342 (2000).

Tamura et al., "The F(ab)'2 fragment of an Abeta-specific monoclonal antibody reduces abeta deposits in the brain," Neurobiol. Disease 20(2):541-549 (2005).
Tsiftsoglou, S. and R. Sim, "Human complement factor I does not require cofactors for cleavage of synthetic substrates," J. Immunol. 173(1):367-375 (2004).
Tsiftsoglou et al., "The catalytically active serine protease domain of human complement factor I," Biochem. 44(16):6239-6249 (2005).
Tyndall, J. and D. Fairlie, "Conformational homogeneity in molecular recognition by proteolytic enzymes," J. Mol. Recog. 12(6):363-370 (1999).
Tyndall et al., "Proteases universally recognize beta strands in their active sites," Chem. Rev. 105(3):973-999 (2005).
UniProtKB/Swiss-Prot No. Q9Y5Y6 (accessed on Mar. 13, 2007) [online].
USPTO in house BLAST alignment SEQ ID No. 310 (of 4903) with Q53HP3_P53HP3 (Performed Feb. 17, 2011).
USPTO in house BLAST alignment SEQ ID No. 311 (of 4903) with Q53HP3_P53HP3 (Performed Feb. 17, 2011).
Wagner et al., "Nucleotide sequence of the thymidine kinase gene of herpes simplex virus type 1," Proc. Natl. Acad. Sci. U.S.A. 78:1441-1445 (1981).
Wang et al., "Amelioration of lupus-like autoimmune disease in NZB/WF1 mice after treatment with a blocking monoclonal antibody specific for complement component C5," Proc. Natl. Acad. Sci. U.S.A. 90:8563-8568 (1996).
Wang et al., "Crystal structure of thrombin-ecotin reveals conformational changes and extended interactions," Biochem. 40(34):10038-10046 (2001).
Wang et al., "Anti-C5 monoclonal antibody therapy prevents collagen-induced arthritis and ameliorates established disease," Proc. Natl. Acad. Sci. U.S.A. 92(19):8955-8959 (1995).
Watson et al., "Molecular biology of the gene," 4th Edition, The Benjamin/Cummings Publishing: Menlo Park, CA, p. 224 (1987).
Waugh et al., "The structure of the pro-apoptotic protease granzyme B reveals the molecular determinants of its specificity," Nature Struc. Biol. 7(9):762-765 (2000).
Weiner, et al., "Liposome-collagen gel matrix: a novel sustained drug delivery system," J. Pharm. Sci. 74(9):922-925 (1985).
Weirich, J. and H. Antoni, "Rate-dependence of antiarrhythmic and proarrhythmic properties of class I and class III antiarrhythmic drugs," Basic Res. Cardiol. 93:125-132 (1998).
Whisstock, J. and A. Lesk, "Prediction of protein function from protein sequence and structure," Q. Rev. Biophys. 36(3):307-340 (2003).
Wright et al., "Communication between receptors for different ligands on a single cell: ligation of fibronectin receptors induces a reversible alterations in the function of complement receptors on cultures human monocytes," J. Cell. Biol. 99:336-339 (1984).
Wymore et al., "Tissue and species distribution of mRNA for the IKr-like K+ channel, erg," Circ. Res. 80:261-268 (1997).
Yamamoto et al., "Identification of a functional promoter in the long terminal repeat of Rous sarcoma virus," Cell 22:787-797 (1980).
Yasojima et al., "Up-regulated product and activation of the complement system in Alzheimer's Disease Brain," American J. of Pathology 154(3):927-936 (1999).
Zhang et al., "Determinants of proteasome recognition of ornithine decarboxylase, a ubiquitin-independent substrate," EMBO J., 22:1488-1496 (2003).
Zhang et al., "Distinct contributions of residue 192 to the specificity of coagulation and fibrinolytic serine proteases," J. Biol. Chem. 274(11):7153-7156 (1999).
Zilow et al., "Complement activation and the prognostic value of C3a in patients at risk of adult respiratory distress syndrome," Clin..Exp. Immunol. 79:151-157 (1990).
International Search Report, dated Jul. 27, 2007, in connection with corresponding International Patent Application No. PCT/US2006/041165.
Response to International Search Report, dated Oct. 25, 2007, in connection with corresponding International Patent Application No. PCT/US2006/041165, 15 pages.

(56) References Cited

OTHER PUBLICATIONS

Written Opinion, dated Feb. 12, 2008, in connection with corresponding International Patent Application No. PCT/US2006/041165.
Response to Written Opinion, dated Mar. 12, 2008, in connection with corresponding International Patent Application No. PCT/US2006/041165, 15 pages.
Examiner's Report, dated Jun. 3, 2009, in connection with corresponding European Patent Application No. 06817259.2, 5 pages.
Examiner's Report, dated Aug. 27, 2009, in connection with corresponding Australian Patent Application No. 2011218753.
Response to Search Report and Written Opinion, dated Oct. 29, 2009, in connection with corresponding Singapore Patent Application No. 200802861-5, 16 pages.
Examiner's Report, dated Mar. 18, 2010, in connection with corresponding New Zealand Patent Application No. 606504.
Response to Examiner's Report, dated Apr. 7, 2010, in connection with corresponding European Patent Application No. 06817259.2, 28 pages.
Search Report and Written Opinion, dated Jun. 3, 2010, in connection with corresponding Singapore Patent Application No. 200802861-5.
Translation of Official Action, dated Jul. 8, 2010, in connection with corresponding Israeli Patent Application No. 190954.
Office Action, dated Jul. 12, 2010, in connection with corresponding U.S. Appl. No. 13/506,603, 19 pages.
Office Action, dated Sep. 10, 2010, in connection with corresponding Chinese Patent Application No. 200680047900.5, 10 pages.
Office Action, dated Sep. 16, 2010, in connection with corresponding Korean Patent Application No. 10-2008-7011682, 10 pages.
Response, dated Oct. 29, 2010, in connection with corresponding Singapore Patent Application No. 200802861-5.
Examiner's Report, dated Jan. 26, 2011, in connection with corresponding Canadian Patent Application No. 2,626,356, 4 pages.
Examination Report, dated Feb. 24, 2011, in connection with corresponding European Patent Application No. 06817259.2, 6 pages.
Instructions for Response to Office Action, dated Mar. 16, 2011, in connection with corresponding Korean Patent Application No. 10-2008-7011682, 49 pages.
E-mail correspondence from examiner, dated Mar. 16, 2011, in connection with corresponding U.S. Appl. No. 13/506,603, 3 pages.
English Translation of Official Action, dated Mar. 22, 2011, in connection with corresponding Japanese Patent Application No. 2008-536847, 7 pages.
Translation of Response, dated Mar. 25, 2011, in connection with corresponding Chinese Patent Application No. 200680047900.5, 25 pages.
Office Action, dated Mar. 30, 2011, in connection with corresponding U.S. Appl. No. 11/584,776, 19 pages.
Search Report and Written Opinion, dated Apr. 20, 2011, in connection with corresponding Singapore Patent Application No. 200802861-5, 27 pages.
Response to Examination Report, dated May 4, 2011, in connection with corresponding Israeli Patent Application No. 190954, 26 pages.
Response to Examination Report, dated May 16, 2011, in connection with corresponding Australian Patent Application No. 2006304804, 30 pages.
Notice of Acceptance, dated May 18, 2011, in connection with corresponding Australian Patent Application No. 2006304804, 3 pages.
Response to Examiner's Report, dated Jul. 26, 2011, in connection with corresponding Canadian Patent Application No. 2,626,356, 54 pages.
Notice of Grant, dated Aug. 5, 2011, in connection with corresponding Chinese Patent Application No. 200680047900.5, 1 page.
Translation of Official Action, dated Sep. 1, 2011, in connection with corresponding Mexican Patent Application No. MX/a/2008/004693, 8 pages.

Response to Examination Report, dated Sep. 6, 2011, in connection with corresponding European Patent Application No. 06817259.2, 31 pages.
Decision of Rejection, issued Sep. 19, 2011, in connection with corresponding Korean Patent Application No. 10-2008-7011682, 9 pages.
English Translation of Reponse, dated Sep. 22, 2011, in connection with corresponding Japanese Patent Application No. 2008-536847, 61 pages.
Response to Examination Report, dated Sep. 29, 2011, in connection with corresponding New Zealand Patent Application No. 595193, 48 pages.
Examination Report, dated Oct. 11, 2011, in connection with corresponding European Patent Application No. 06817259.2, 13 pages.
Instructions for Response to Office Action and translation of claims, Oct. 18, 2011, in connection with corresponding Korean Patent Application No. 10-2008-7011682, 14 pages.
Examination Report, dated Oct. 19, 2011, in connection with corresponding in connection with corresponding New Zealand Patent Application No. 595193, 4 pages.
Official Action, dated Dec. 13, 2011, in connection with corresponding Korean Patent Application No. 10-2011-7006136, 4 pages.
Decision to Grant, dated Dec. 14, 2011, in connection with corresponding Korean Patent Application No. 10-2008-7011682, 4 pages.
English translation of Response, dated Jan. 11, 2012, in connection with corresponding Mexican Patent Application No. MX/a/2008/004693, 48 pages.
Extended European Search Report dated Feb. 10, 2012, in connection with corresponding European Patent Application No. 11169346.1, 10 pages.
Partial European Search Report, dated Feb. 13, 2012, in connection with corresponding European Patent Application No. 11169348.7, 13 pages.
Examination Report, dated Mar. 1, 2012, in connection with corresponding Indian Patent Application No. 04017/DELNP/2008, 5 pages.
Translation of Official Action, dated Mar. 13, 2012, in connection with corresponding Mexican Patent Application No. MX/a/2008/004693, 4 pages.
Examination Report, dated Mar. 14, 2012, in connection with corresponding Canadian Patent Application No. 2,626,356, 6 pages.
Reponse to Examination Report, dated Mar. 28, 2012, in connection with corresponding European Patent Application No. 06817259.2, 13 pages.
Examination Report, dated Apr. 10, 2012, in connection with corresponding European Patent Application No. 06817259.2, 30 pages.
Written Opinion, dated Apr. 17, 2012, in connection with corresponding Singapore Patent Application No. 200802861-5, 3 pages.
Response to Examination Report, dated Apr. 27, 2012, in connection with corresponding European Patent Application No. 11169348.7, 21 pages.
Englilsh Translation of Final Rejection, dated Jun. 5, 2012, in connection with corresponding Japanese Patent Application No. 2008-536847, 7 pages.
Extended European Search Report, dated Jun. 8, 2012, in connection with corresponding European Patent Application No. 11169348.7, 21 pages.
Response to Office Action and translation of claims, dated Jun. 13, 2012, in connection with corresponding Korean Patent Application No. 10-2011-7006136, 61 pages.
Communication of Intention to Grant, dated Jun. 26, 2012, in connection with corresponding European Patent Application No. 06817259.2, 7 pages.
Response to Official Action and translation of claims, dated Jul. 25, 2012, in connection with corresponding Mexican Patent Application No. MX/a/2008/004693, 50 pages.
Correspondence from foreign associate notifying allowance of patent, dated Aug. 21, 2012, in connection with corresponding Mexican Patent Application No. MX/a/2008/004693, 1 page.

(56) References Cited

OTHER PUBLICATIONS

Translation of Official Action, dated Sep. 3, 2012, in connection with corresponding Israeli Patent Application No. 190954, 2 pages.
Response to Examination Report, dated Sep. 13, 2012, in connection with corresponding European Patent Application No. 11169346.1, 19 pages.
Response to Examiner's Report, dated Sep. 14, 2012, in connection with corresponding Canadian Patent Application No. 2,626,356, 42 pages.
Response to Written Opinion, dated Sep. 17, 2012, in connection with corresponding Singapore Patent Application No. 200802861-5, 22 pages.
Examination Report, dated Sep. 20, 2012, in connection with corresponding Australian Patent Application No. 2011218753, 5 pages.
Restriction Requirement, dated Sep. 21, 2012, in connection with corresponding U.S. Appl. No. 13/506,603, 8 pages.
Notice of Appeal, dated Oct. 5, 2012, in connection with corresponding Japanese Patent Application No. 2008-536847, 19 pages.
Correspondence notifying grant of patent, dated Oct. 11, 2012, in connection with corresponding Mexican Patent Application No. MX/a/2008/00469s, 1 page.
Response to Examiner's Report, dated Oct. 22, 2012, in connection with corresponding Australian Patent Application No. 2011218753, 25 pages.
Formality Office Action, dated Oct. 23, 2012, in connection with corresponding Japanese Patent Application No. 2008-536847, 2 pages.
Translation of Office Action, dated Oct. 30, 2012, in connection with corresponding Korean Patent Application No. 10-2011-7006136, 10 pages.
Examination Report, dated Nov. 7, 2012, in connection with corresponding European Patent Application No. 11169346.1, 9 pages.
Decision to Grant, dated Nov. 15, 2012, in connection with corresponding European Patent Application No. 06817259.2, 2 pages.
Appeal Brief, dated Nov. 20, 2012, in connection with corresponding Japanese Patent Application No. 2008-536847, 36 pages.
Response to Examination Report, dated Jan. 10, 2013, in connection with corresponding European Patent Application No. 11169348.7, 33 pages.
Correspondence notifying grant of patent, dated Feb. 20, 2013, in connection with corresponding Japanese Patent Application No. 2008-536847, 4 pages.
Response to Examiner's Report, dated Jan. 31, 2013, in connection with corresponding New Zealand Patent Application No. 595193, 20 pages.
Examiner's Report, dated Feb. 8, 2013, in connection with corresponding New Zealand Patent Application No. 606504, 3 pages.
Examiner's Report, dated Feb. 15, 2013, in connection with corresponding New Zealand Patent Application No. 595193, 3 pages.
Response to Examiner's Report and amended claims, dated Feb. 18, 2013, in connection with corresponding New Zealand Patent Application No. 595193, 8 pages.
Examiner's Report, dated Feb. 28, 2013, in connection with corresponding New Zealand Patent Application No. 595193, 3 pages.
English Translation of Response to Office Action, dated Mar. 1, 2013, in connection with corresponding Indian Patent Application No. 04017/DELNP/2008, 26 pages.
Examiner's Report, dated Mar. 7, 2013, in connection with corresponding Singapore Patent Application No. 200802861-5, 7 pages.
English Translation of Office Action, dated Mar. 15, 2013,and translation, in connection with corresponding Chinese Patent Application No. 201110327286.0, 9 pages.
Response to Restriction Requirement, dated Mar. 21, 2013, in connection with corresponding U.S. Appl. No. 13/506,603, 10 pages.
English Translation of Response to Office Action, dated Apr. 29, 2013, and instructions for response, in connection with corresponding Korean Patent Application No. 10-2011-7006136, 120 pages.

Response to Examination Report, dated May 17, 2013, in connection with corresponding European Patent Application 11169346.1, 19 pages.
Examiner Initiated Interview Summary, dated Jun. 10, 2013, in connection with corresponding U.S. Appl. No. 13/506,603, 2 pages.
Examiner Initiated Interview Summary, dated Jun. 14, 2013, in connection with corresponding U.S. Appl. No. 13/506,603, 2 pages.
Office Action,dated Jun. 18, 2013, in connection with corresponding U.S. Appl. No. 13/506,603, 17 pages.
English Translation of Response to Official Notification, dated Jul. 1, 2013, in connection with corresponding Israeli Patent Application No. 190954, 26 pages.
Examiner's Report, dated Jul. 29, 2013, in connection with corresponding Canadian Patent Application No. 2,626,356, 10 pages.
Response to Examiner's Report, dated Aug. 15, 2013, in connection with corresponding New Zealand Patent Application No. 595193, 14 pages.
English Translation of Decision to Reject, dated Aug. 29, 2013, in connection with corresponding Korean Patent Application No. 10-2011-7006136, 13 pages.
Notice of Acceptance, dated Sep. 2, 2013, in connection with corresponding New Zealand Patent Application No. 595193, 4 pages.
Response to Office Action, dated Sep. 18, 2013, in connection with corresponding U.S. Appl. No. 13/506,603, 55 pages.
Response to Examiner's Report, dated Sep. 20, 2013, in connection with corresponding Australian Patent Application No. 2011218753, 16 pages.
Summon for Oral Hearing, dated Sep. 27, 2013, in connection with corresponding European Patent Application No. 11169346.1, 6 pages.
English Tranlation of Response to Office Action, dated Sep. 30, 2013, in connection with corresponding Chinese Patent Application No. 201110327286.0, 23 pages.
Notice of Acceptance, dated Oct. 11, 2013, in connection with corresponding Australian Patent Application No. 2011218753, 2 pages.
Examination Report, dated Oct. 23, 2013, in connection with corresponding European Patent Application No. 11169348.7, 9 pages.
English Translation of Supplemental Response to Office Action, dated Oct. 25, 2013, in connection with corresponding Chinese Patent Application No. 201110327286.0, 5 pages.
Office Action, dated Nov. 12, 2013, in connection with corresponding U.S. Appl. No. 13/506,603, 30 pages.
Notification of Hearing, dated Nov. 28, 2013, in connection with corresponding Indian Patent Application No. 04017/DELNP/2008, 2 pages.
English Translation of Response to Office Action, dated Dec. 27, 2013, in connection with corresponding Korean Patent Application No. 10-2011-7006136, 18 pages.
English Translation of Office Action, dated Dec. 30, 2013, in connection with corresponding Chinese Patent Application No. 201110327286.0, 2 pages.
English Translation of Notice of Allowance, dated Feb. 5, 2014, in connection with corresponding Korean Patent Application No. 10-2011-7006136, 1 page.
English Translation of Preliminary Rejection, dated Feb. 5, 2014, in connection with corresponding Korean Patent Application No. 10-2013-7034742, 3 pages.
English Translation of Office Action, dated Apr. 15, 2014, and a summary in English, in connection with corresponding Japanese Patent Application No. 2012-223555, 4 pages.
Response to Office Action, dated Apr. 29, 2014, in connection with corresponding European Patent Application No. 11169348.7, 7 pages.
Letter/Written Disclosure of the Supplemental Information Disclosure Statement for the above-referenced application, dated May 17, 2016, 2 pages.
Final Office Action, dated Oct. 13, 2015, in connection with corresponding Japanese Patent Application No. 2012-223555 [English translation and original document in Japanese] 4 pages.

(56) References Cited

OTHER PUBLICATIONS

Official Notification, dated Oct. 26, 2015, in connection with Israeli Patent Application No. 190954, 2 pages.
Response, dated Oct. 28, 2015, to Final Office Action, dated Oct. 13, 2015, in connection with corresponding Japanese Patent Application No. 2012-223555, [English instructions and response as filed in Japanese], 15 pages.
Office Action, dated Oct. 28, 2015, in connection with Korean Patent Application No. 10-2013-7034742 [English translation and original document in Korean], 5 pages.
Response, dated Nov. 20, 2015, to Office Action, dated Oct. 28, 2015, in connection with Korean Patent Application No. 10-2013-7034742 [English translation and original document in Korean], 22 pages.
Letter, received Nov. 28, 2015, reporting Decision to Grant, dated Nov. 24, 2015, in connection with Japanese Patent Application No. 2012-223555 [English letter and original document in Japanese], 4 pages.
Response, dated Dec. 9, 2015, to Official Notification, dated Oct. 26, 2015, in connection with Israeli Patent Application No. 190954 [English translation], 7 pages.
Response, dated Dec. 15, 2015, to Examination Report, dated Jun. 5, 2015, in connection with European Patent Application No. 11169348.7, 471 pages.
Office Action, dated Feb. 17, 2016, in connection with Korean Patent Application No. 10-2013-7034742 [English translation and original document in Korean], 7 pages.
Examination Report, dated Mar. 16, 2016, in connection with Canadian Patent Application No. 2626356, 4 pages.
Communication under Rule 71(3) EPC, Intention to Grant, dated Mar. 17, 2016, in connection with European Patent Application No. 11169348.7, 5 pages.
Final Examination Report, dated May 4, 2016, in connection with Singapore Patent Application No. 2013044581, 7 pages.
Response, dated May 12, 2016, to Examination Report, dated Mar. 16, 2016, in connection with Canadian Patent Application No. 2626356, 9 pages.
Dybkaer, R. "Unit "Katal" for Catalytic Activity (IUPAC Technical Report)," Pure Appl. Chem., 73(6):927-931 (2001), 5 pages.
Fersht, A., "Structure and Mechanism in Protein Science a Guide to Enzyme Catalysis and Protein Folding," W.H. Freeman and Company, New York, pp. 111 (1999), 3 pages.
National Institute of Standards and Technology, "The International System of Units (SI) NIST Special Publication 330," pp. 1-68 (2001 Edition), 77 pages.
Letter/Written Disclosure of the Supplemental Information Disclosure Statement for the above-referenced application, dated Jan. 19, 2017, 2 pages.
Catalyst Biosciences Press Release, "Catalyst Biosciences to Present at Opthalmology Innovation Summit: Presentation to highlight preclinical data supporting knock down of complement factor 3, the central regulator of the complement cascade." Published on Aug. 3, 2016 [online]; Retrieved on Nov. 28, 2016, from: <URL:ir.catalystbiosciences.com/phoenix.zhtml?c=254141&p=irol-newsArticle&ID=2192374>, 3 pages.
Catalyst Biosciences Presentation: "Anti-Complement (C3) for Dry AMD OIS@ASRS," Presented at the Opthalmology Innovation Summit meeting, at the American Society of Retina Specialists on Aug. 8, 2016, San Francisco, CA., 8 pages.
Catalyst Biosciences: The Protease Therapeutics Company, "Company Overview Jun. 2014," Published Jun. 2, 2014 [online]; Retrieved on Nov. 29, 2016 from: <URL:ir.catalystbiosciences.com/phoenix.zhtml?c=254141&p=irol-newsArticle&ID=2192374>, 19 pages.
Catalyst Biosciences: Company Overview, Presentation, May 2016 [online]; Retrieved on Jan. 17, 2016, from: <URL:ir.catalystbiosciences.com/phoenix.zhtml?c=254141&p=irol-calendar>, 25 pages.
Catalyst Biosciences Press Release, "Catalyst Biosciences Receives Patent Covering its Hemostasis and Anti-Complement Programs," Published on Jun. 20, 2016 [online]; Retrieved on Jan. 17, 2017, from: <URL:ir.catalystbiosciences.com/phoenix.zhtml?c=254141&p=irol-newsArticle&ID=2178726>, 2 pages.
Catalyst Biosciences Presentation, presented at the Jefferies 2016 Complement Therapeutics Summit in New York City, on May 3, 2016, 22 pages.
Janeway et al., "The complement system and innate immunity" In: Immunobiology: The Immune System in Health and Disease, 6th edition. Garland Science, New York, N.Y., (2004), 32 pages.
Response, dated Aug. 17, 2016, to Office Action, dated Feb. 17, 2016, in connection with corresponding Korean Patent Application No. 10-2013-7034742 [English instructions and response as filed in Korean], 52 pages.
Certificate of Grant, dated Nov. 29, 2016, in connection with Singapore Patent Application No. 2013044581, 1 page.
Letter/Written Disclosure of the Supplemental Information Disclosure Statement for the above-referenced application, dated Nov. 22, 2016, 3 pages.
Notification Prior to Allowance, dated Sep. 22, 2016, in connection with corresponding Israeli Patent Application No. 190954 [English translation], 2 pages.
Letter, dated Oct. 12, 2016, detailing the Revocation of a Rejection Decision, dated Aug. 22, 2016, in connection with Chinese Patent Application No. 201110327286.0 [English letter and original document in Chinese], 9 pages.
Decision to Grant, dated Oct. 27, 2016, in connection with Korean Patent Application No. 10-2013-7034742 [English language translation and original document in Korean], 3 pages.
Decision to Grant, dated Nov. 10, 2016, in connection with European Patent Application No. 11169348.7, 2 pages.

* cited by examiner

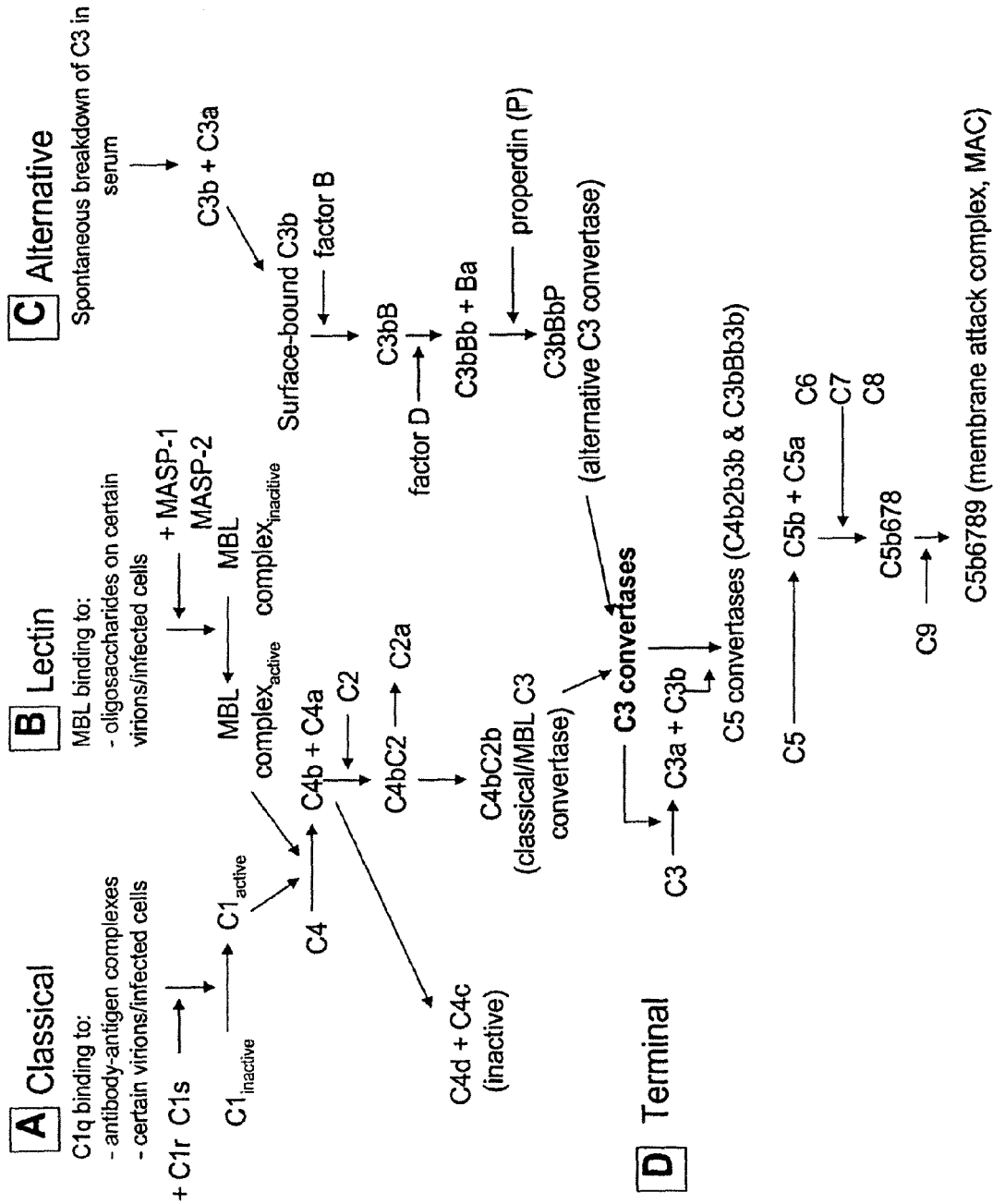

MODIFIED MT-SP1 PROTEASES THAT INHIBIT COMPLEMENT ACTIVATION

RELATED APPLICATIONS

This application is a continuation of U.S. patent application Ser. No. 13/506,603, entitled "MODIFIED PROTEASES THAT INHIBIT COMPLEMENT ACTIVATION," filed on Apr. 30, 2012, which is a divisional of U.S. patent application Ser. No. 11/584,776, entitled "MODIFIED PROTEASES THAT INHIBIT COMPLEMENT ACTIVATION," filed on Oct. 20, 2006, now abandoned, which claims priority to U.S. Provisional Application Ser. No. 60/729,817, filed Oct. 21, 2005, entitled "MODIFIED PROTEASES THAT INHIBIT COMPLEMENT ACTIVATION," to Edwin Madison. The subject matter of this application is incorporated by reference in it entirety.

This application is related to International PCT application No. PCT/US2006/41165, filed Oct. 20, 2006, entitled "MODIFIED PROTEASES THAT INHIBIT COMPLEMENT ACTIVATION," to Edwin Madison, Jack Nguyen, Sandra Waugh Ruggles and Christopher Thanos, which also claims priority to U.S. Provisional Application Ser. No. 60/729,817.

This application also is related to U.S. application Ser. No. 10/677,977, filed Oct. 2, 2003, entitled Methods of Generating and Screening for Proteases with Altered Specificity; to U.S. application Ser. No. 11/104,110, filed Apr. 12, 2005, entitled Cleavage of VEGF and VEGF Receptor by Wild-Type and Mutant MTSP-1; and to U.S. application Ser. No. 11/104,111, filed Apr. 12, 2005, entitled Cleavage of VEGF and VEGF Receptor by Wild-Type and Mutant Protease.

The subject matter of each of the above-noted applications is incorporated by reference in its entirety.

INCORPORATION BY REFERENCE OF SEQUENCE LISTING PROVIDED ELECTRONICALLY

An electronic version of the Sequence Listing is filed herewith, the contents of which are incorporated by reference in their entirety. The electronic file was created on May 9, 2014, is 2,308 kilobytes in size, and titled 4903CSEQ001.txt.

FIELD OF INVENTION

Provided are methods for and compounds for modulating the complement system. In particular, compounds are provided that inhibit complement activation and compounds are provided that promote complement activation. The compounds are therapeutics by virtue of their effects on the complement system. Hence, the compounds that inhibit complement activation can be used for treatment of ischemic and reperfusion disorders, including myocardial infarction and stroke, sepsis, autoimmune diseases, inflammatory diseases and diseases with an inflammatory component, including Alzheimer's Disease and other neurodegenerative disorders.

BACKGROUND

The complement (C) system is part of the immune system and plays a role in eliminating invading pathogens and in initiating the inflammatory response. The complement system of humans and other mammals involves more than 30 soluble and membrane-bound proteins that participate in an orderly sequence of reactions resulting in complement activation. The blood complement system has a wide array of functions associated with a broad spectrum of host defense mechanisms including anti-microbial and anti-viral actions. Products derived from the activation of C components include the non-self recognition molecules C3b, C4b and C5b, as well as the anaphylatoxins C3a, C4a and C5a that influence a variety of cellular immune responses. These anaphylatoxins also act as pro-inflammatory agents.

The complement system is composed of an array of enzymes and non-enzymatic proteins and receptors. Complement activation occurs by one of three primary modes known as the "classical" pathway, the "alternative" pathway and the "lectin" pathway (see FIG. 1). These pathways can be distinguished by the process that initiates complement activation. The classical pathway is initiated by antibody-antigen complexes or aggregated forms of immunoglobulins; the alternative pathway is initiated by the recognition of structures on microbial and cell surfaces; and the lectin pathway, which is an antibody-independent pathway, is initiated by the binding of mannan binding lectin (MBL, also designated mannose binding protein) to carbohydrates such as those that are displayed on the surface of bacteria or viruses. Activation of the cascades results in production of complexes involved in proteolysis or cell lysis and peptides involved in opsonization, anaphylaxis and chemotaxis.

The complement cascade, which is a central component of an animal's immune response, is an irreversible cascade. Numerous protein cofactors regulate the process. Inappropriate regulation, typically inappropriate activation, of the process is a facet of or can occur in a variety of disorders that involve inappropriate inflammatory responses, such as those observed in acute and chronic inflammatory diseases. These diseases and disorders include autoimmune diseases, such as rheumatoid arthritis and lupus, cardiac disorders and other inflammatory diseases, such as sepsis and ischemia-reperfusion injury.

Because of the involvement of the complement pathways in a variety of diseases and conditions, components of the complement pathways are targets for therapeutic intervention, particularly for inhibition of the pathway. Examples of such therapeutics include synthetic and natural small molecule therapeutics, antibody inhibitors, and recombinant soluble forms of membrane complement regulators. There are limitations to strategies for preparing such therapeutics. Small molecules have short half-lives in vivo and need to be continually infused to maintain complement inhibition thereby limiting their role, especially in chronic diseases. Therapeutic antibodies result in an immune response in a subject, and thus can lead to complications in treatment, particularly treatments designed to modulate immune responses. Thus, there exists an unmet need for therapeutics for treatment of complement-mediated diseases and diseases in which complement activation plays a role. These include acute and chronic inflammatory diseases. Accordingly, among the objects herein, it is an object to provide such therapeutics to target the activation of the complement cascade and to provide therapeutics and methods of treatment of diseases.

SUMMARY

Provided herein are therapeutics and methods that target the activation of the complement cascade and methods of treatment of diseases, including acute and chronic inflammatory diseases. The therapeutics are non-complement proteases that target complement pathway substrates. Included among the non-complement proteases are unmodified proteases that cleave their native substrate as well as a complement substrate and also proteases modified to have increased selectivity or substrate specificity for a target substrate. The modified proteases can exhibit reduced or altered activity with respect to their native substrates.

Among the methods provided herein are methods of modulating complement activation by contacting a non-complement protease with any one or more, such as 2, 3, 4, 5, 6, 7, 8, 9, 10, 11, 12, 13, 14, 15, 20, 25, 30 or more target substrates of a complement pathway, whereby a target substrate protein is cleaved such that complement activation in a pathway comprising the target substrate is altered. Uses of proteases for treatment and/or for formulation of medicaments also are provided. Target substrates for these methods and for any of the methods and uses provide herein are complement proteins, including: C1q, C2, C3, iC3, C4, iC4, C5, C6, C7, C8, C9, MBL, Factor B, Factor D, Factor P, MASP-1, MASP-2, C1r, C1s, C4b, C4a, C2b, C2a, C3b, C3a, Ba, Bb and ficolin. Contacting can be effected ex vivo, in vitro and/or in vivo. Exemplary targets include any of those having a sequence of amino acids set forth in any of SEQ ID NOS: 298, 299, 300, 302, 304, 305, 306, 311, 312, 313, 314, 315, 316, 317, 318, 319, 320, 321, 322, 326, 328, 330, 332, 334, 335, 338, 340, 344, 660-662 and a fragment of any of the targets that exhibits a complement pathway activity, or allelic or species variants thereof or polypeptides having 60, 70, 80, 85, 90, 95, 96, 97, 98, 99% or more sequence identity.

For all and for any methods and uses provided herein, the target substrates can be present in a body fluid or tissue sample, or can be a collection of target substrates or any other composition containing such substrates. Depending upon the target substrate(s), complement activation can be inhibited or activated. The methods target one or more any complement pathway. Thus, the complement pathway modulated can be selected from among one or more of the classical, alternative and lectin pathways of complement. The non-complement proteases contain modifications at any one or more amino acid residues, such as 1, 2, 3, 4, 5, 6, 7, 8, 9, 10, 12, 15, 20, 25, 30, 35 or more residues, compared to an unmodified or scaffold protease. The modified amino acid residue(s) increases one or both of specificity for a target substrate or activity towards a target substrate. Exemplary unmodified or scaffold proteases include any one of a serine protease, a cysteine protease, an aspartic protease, a threonine protease and a metallo-protease, such as, for example, granzyme B, granzyme A, granzyme M, cathepsin G, MT-SP1, neutrophil elastase, chymase, alpha-tryptase, beta-tryptase I or II, chymotrypsin, collagenase, factor XII, factor XI, factor CII, factor X, thrombin, protein C, u-plasminogen activator (u-PA), t-plasminogen activator (t-PA), plasmin, plasma kallikrein, chymotrypsin, trypsin, a cathepsin, papain, cruzain, a metalloprotease and allelic variations, isoforms and catalytically active portions thereof. For example, the scaffold protease comprises a sequence of amino acids set forth in any one of SEQ ID NOS: 2, 4, 8, 77, 79, 83, 85, 87, 89, 93, 99, 117, 119, 121, 123, 132, 134, 138, 142, 144, 146, 148, 162, 166, 168, 170, 172, 174, 176, 178, 180, 182, 190, 192, 194, 196, 198, 200, 202, 204, 206, 208, 218, 220, 222, 224, 226, 238, 248, 250, 260, 262, 280, 282, 373, 375, 377, 379, 381, 383, 385, 387, 547, 549, and 551 and catalytically active portions thereof, allelic and species variants thereof and polypeptides having 60, 70, 80, 85, 90, 95, 96, 97, 98, 99% or more sequence identity. MT-SP1 or a fragment thereof, such as the polypeptide sequence set forth in SEQ ID NO: 2 and 10, respectively, is exemplary of a scaffold protease. C2 or C3 proteins of a complement pathway(s) are exemplary target substrates of an MT-SP1 protease, modified MT-SP1 protease, or catalytically active portions thereof.

Modification of an MT-SP1 protease or a catalytically active portion thereof include modification(s) at positions 146, 224, 41, and/or 151, based on chymotrypsin numbering. Such modified MT-SP1 proteases include those with any of the following modifications: I41T/Y146D/G151L/K224F, I41T/Y146D/G151L/Q175D/K224F, I41T/Y146D/G151L/Q175D/K224L, I41T/Y146D/G151L/Q175D/K224R, AND I41T/Y146D/G151L/Q175D/K224N, I41T/Y146D/G151L/K224N, Y146D/G151L/K224N, I41T/Y146D/G151L/Q175K/K224F, I41T/Y146D/G151L/Q175R/K224F, I41T/Y146D/G151L/Q175H/K224F, I41T/Y146D/G151L/Q175Y/K224F, I41T/Y146D/G151L/Q175K/K224N, I41T/Y146D/G151L/Q175R/K224N, I41T/Y146D/G151L/Q175H/K224N, and I41T/Y146D/G151L/Q175Y/K224N, based on chymotrypsin numbering. In particular, a modified MT-SP1 contains amino acid modifications I41T/Y146D/G151L/K224F.

The modifications can be in any one or more amino acids that contribute to extended substrate specificity or secondary sites of interaction, such as, for example, modifications in an MT-SP1 protease or a catalytically active portion thereof that correspond to any one or more of amino acid positions 97, 146, 192, and 224 of an MT-SP1 protease, based on chymotrypsin numbering. Exemplary of such modifications are one or more of F97, Y146, Q192, and K224 of the MT-SP1 protease, based on chymotrypsin numbering, such as F97D, F97E, F97A, F97W, Y146N, Y146D, Y146E, Y146A, Y146W, Y146R, Q192R, Q192V, K224A, and K224F. Exemplary of such modified MT-SP1 proteases include those polypeptides having a sequence of amino acids set forth in any of SEQ ID NOS: 16, 18, 20, 22, 24, 26, 28, 30, 32, 34, 36, 14, 38, and 40 and 405-418. Other examples of a modified MT-SP1 protease or a catalytically active portion thereof include amino acid modifications Y146D/K224F or Y146E, such as those corresponding to a modified MT-SP1 polypeptide having a sequence of amino acids as set forth in SEQ ID NOS:12, 404, 28 or 412.

MT-SP1 protease and catalytically active portions thereof include polypeptides that contain one or more of the following modifications: F97N, F97D, F97E, F99Y, F99V, F99W, D217A, D217V, F97A, F97W, F99A, Y146N, Y146D, Y146E, Y146A, Y146W, Y146R, W215F, W215Y, Q192V, Q192R, Q192F, K224A, K224F, M180E, Y146D/K224F, D96A, Y146E/K224N, I41T/Y146E/Q175D/K224R, I41T/Y146D/K224F, I41T/Y146E/Q175D/K224N, I41T/Y146E/G151L/Q175D/K224L, Y146E/Q221aE/K224F, I41T/Y146E/G151L/Q175D/K224R, I41T/Y146E/G151L/Q175D/K224N, Q221aD, Y146E/K224R, Y146E/Q175D/K224N, Y146D/K224R, I41T/Y146E/G151L/Q175D/K224F, Y146E/Q175D/K224R, Y146E/L224L, G147E, Y146D/Q175D/K224R, Y146D/Q175L/K224L, Y146D/Q175L/K224L, Y146D/Q175W/K224L, Y146D/K224L, Y146E/Q221aE/K224R, Y146E/K224A, Y146D/Q175H/K224L, Y146D/Q175Y/K224L, Y146E/K224Y, Y146D/Q175F/K224L, Y146D/Q175F/K225L, Y146D/Q221aL/K224S, I41E/Y146D/K224L, Y146D/D217F/K224L, Y146D/D217F/K224L, H143V/Y146D/K224F, Y146E/K224F, Y146A/K224F, Y146E/K224T, I41T/Y146E/K224L, I41F/Y146D/K224F, I41L/Y146D/K224F, I41T/Y146D/G151L/K224F, I41A/Y146D/K224F, I41E/Y146D/K224F, I41D/Y146D/K224L, I41D/Y146D/K224F, Y146N/K224F, I41T/Y146D/Q175D/K224F, Q192F/ K224F, Y146D/Q192A/K224F, Q192V/K224F, I41T/ Y146D/Q175D/K224L, I41T/Y146D/Q175D/K224R, I41T/ Y146D/Q175D/K224N, I41T/Y146D/G151L/Q175D/ K224F, I41T/Y146D/G151L/Q175D/K224L, I41T/Y146D/ G151L/Q175D/K224R, I41T/Y146D/G151L/Q175D/ K224N, I41T/Y146E/Q175D/K224F, I41T/Y146E/Q175D/ K224L, I41T/Y146D/G151L/K224N, Y146D/Q175D/ K224N, Y146D/Q175D/K224N, Y146D/G151L/K224N, Y146D/Q175R/K224N, Y146D/Q175K/K224N, Y146D/ Q175H/K224N, I41T/Y146D/G151L/Q175K/K224F, I41T/ Y146D/G151L/Q175R/K224F, I41T/Y146D/G151L/ Q175H/K224F, I41T/Y146D/G151L/Q175Y/K224F, I41T/ Y146D/G151L/Q175K/K224N, I41T/Y146D/G151L/ Q175R/K224N, I41T/Y146D/G151L/Q175H/K224N, and I41T/Y146D/G151L/Q175Y/K224N, based on chymotrypsin numbering. Exemplary of such modified MT-SP1 proteases, or catalytically active portions thereof, include those polypeptides having a sequence of amino acids set forth in any of SEQ ID NOS: 12, 14, 16, 18, 20, 22, 24, 26, 28, 30, 32, 34, 36, 38, 40-69, 404-418, 419-447, 524-533, 552-659, or 663-710. In particular, a modified MT-SP1 protease, or a catalytically active portion thereof, is one having a sequence of amino acids set forth in SEQ ID NOS: 596 or 650.

For all methods and uses provided herein, the modification can be selected such that the modified protease, such as MT-SP1, cleaves a substrate recognition site of the target substrate. Target substrates are any of the complement pathway polypeptides noted above and known to those of skill in the art, including for example, C2 and/or C3. For example, where the target substrate is C2 the substrate recognition site includes a sequence of amino acids of SLGR (SEQ ID NO:392).

Other recognition sites targeted in the methods and uses provided herein include a Factor I substrate recognition site, such as LPSR (SEQ ID NO: 388), SLLR (SEQ ID NO:389), or HRGR (SEQ ID NO: 390). Modifications in the MT-SP1 protease or a catalytically active portion can correspond to any one or more of amino acid positions 174, 217, 96, 192, 146, or 99 of an MT-SP1 protease, based on chymotrypsin numbering, such as any one or more of amino acids Q174, D217, D96, Q192, Y146, and F99 of a MT-SP1 protease, based on chymotrypsin numbering. Exemplary of such modifications are modifications selected from among one or more of: Q174H, D217Q, D217N, D217H, D96A, D96V, D96F, D96S, D96T, Q192L, Q192I, Q192F, Y146F, F99A, F99V, F99S, and F99G (see, e.g., the polypeptides having a sequence of amino acids set forth in any of SEQ ID NOS: 41-57 or 419-435.

Another recognition site includes the sequence of amino acids LPSR. Exemplary of a modified protease modified for recognition thereof are: an MT-SP1 protease or a catalytically active portion thereof having modifications at sites corresponding to any one or more of amino acid positions 174, 180, 215, 192, or 99 of an MT-SP1 protease, based on chymotrypsin numbering, such as, for example, any one or more of amino acids Q174, M180, W215, Q192, or F99 of a MT-SP1 protease, based on chymotrypsin numbering. Exemplary of such modifications is any one or more of Q174F, Q174V, Q174L, Q174Y, M180E, W215F, W215Y, Q192K, Q192R, Q192Y, and F99Y (see, e.g., modified MT-SP1 polypeptides having a sequence of amino acids as set forth in any of SEQ ID NOS: 36, 58, 59, 61, 62, 69, 416, 436, 437, 439, 440, 447, or 524-533).

Another substrate recognition site for use in the methods herein includes the sequence of amino acids HRGR. Exemplary of a protease with modifications to recognize such sites are an MT-SP1 protease or a catalytically active portion thereof that has modifications that correspond(s) to modifications at any one or more of amino acid positions 215, 174, 217, 192 and 99 of an MT-SP1 protease, based on chymotrypsin numbering, such as, for example, W215, Q174, D217, Q192 and F99 of an MT-SP1 protease, based on chymotrypsin numbering. Exemplary thereof are modifications selected from among: any one or more of W215F, W215Y, Q174A, Q174V, Q174 F, Q174R, Q174K, D217A, D217V, Q192E, F99W and F99Y (e.g., an MT-SP1 protease or a catalytically active portion thereof corresponding to a modified MT-SP1 polypeptide containing a sequence of amino acids as set forth in any of SEQ ID NOS: 58-69 and 436-447.

Methods for treatment of complement-mediated disorders and disorders whose symptoms are ameliorated by modulating a complement pathway, including one or more of the classical, alternative and lectin pathways, are provided. In practicing the methods, one or more non-complement proteases is/are contacted with one or more target substrates, such as by administration in vitro, in vivo or ex vivo, whereby the non-complement protease cleaves any one or more target substrates of a complement pathway such that complement activation in a pathway comprising the target substrate is altered. Uses of the non-complement proteases for treatment of such diseases and disorders and/or for formulation of medicaments for such treatment also are provided. Modulation includes inhibition or enhancement (increasing) complement activation. Inhibition of complement activation can lead to a reduction in inflammatory symptoms associated with a complement-mediated disorder. Exemplary of inflammatory disorders are neurodegenerative disorders and cardiovascular disorders, such as, but are not limited to, sepsis, Rheumatoid arthritis (RA), membranoproliferative glomerulonephritis (MPGN), Multiple Sclerosis (MS), Myasthenia Gravis (MG), asthma, inflammatory bowel disease, immune complex (IC)-mediated acute inflammatory tissue injury, Alzheimer's Disease (AD), Ischemia-reperfusion injury and Guillan-Barre syndrome. Complement-mediated disorders can result from a treatment of a subject. Ischemia-reperfusion injury can be caused by an event or treatment selected from among myocardial infarct (MI), stroke, angioplasty, coronary artery bypass graft, cardiopulmonary bypass (CPB), and hemodialysis.

The methods of treatment provided herein can be effected by administering to a subject a non-complement protease effected prior to treatment of the subject for the manifested disorder. As noted administering can be effected by contacting a body fluid or tissue sample in vitro, ex vivo, or in vivo with a non-complement protease. Complement-mediated ischemia-reperfusion injury is exemplary of such disorders. The treatment causing such disorder is angioplasty or coronary artery bypass graft.

As noted above, in any of the methods and uses provide herein, target substrates include one or more of C1q, C2, C3, iC3, C4, iC4, C5, C6, C7, C8, C9, MBL, Factor B, Factor D, Factor P, MASP-1, MASP-2, C1r, C1s, C4b, C4a, C2b, C2a, C3b, C3a, Ba, Bb and ficolin, such as a substrate that contains a sequence of amino acids set forth in any one of SEQ ID NOS: 298, 299, 300, 302, 304, 305, 306, 311, 312, 313, 314, 315, 316, 317, 318, 319, 320, 321, 322, 326, 328, 330, 332, 334, 335, 338, 340, and 344, or is fragment thereof that exhibits a complement activity.

In these methods and uses and all methods and uses provided herein, the non-complement protease can include modifications at any one or more amino acid residues compared to an unmodified or scaffold protease, wherein the modified amino acid residue(s) increases one or both of specificity for a target substrate or activity towards a target substrate. Unmodified or scaffold protease include any one of a serine protease, cysteine protease, aspartic protease, threonine protease, or metallo-protease, such as granzyme B, granzyme A, granzyme M, cathepsin G, MT-SP1, neutrophil elastase, chymase, alpha-tryptase, beta-tryptase I or II, chymotrypsin, collagenase, factor XII, factor XI, factor CII, factor X, thrombin, protein C, u-plasminogen activator (u-PA), t-plasminogen activator (t-PA), plasmin, plasma kallikrein, chymotrypsin, trypsin, a cathepsin, papain, cruzain, a metalloprotease and allelic variations, isoforms and catalytically active portions thereof. Exemplary are those that contain or have a sequence of amino acids as set forth in any one of SEQ ID NOs: 2, 4, 8, 77, 79, 83, 85, 87, 89, 93, 99, 117, 119, 121, 123, 132, 134, 138, 142, 144, 146, 148, 162, 166, 168, 170, 172, 174, 176, 178, 180, 182, 190, 192, 194, 196, 198, 200, 202, 204, 206, 208, 218, 220, 222, 224, 226, 238, 248, 250, 260, 262, 280, 282, 373, 375, 377, 379, 381, 383, 385, 387, 547, 549, and 551 and catalytically active portions thereof. MT-SP1 is an exemplary scaffold protease provided herein and is as described above. Cleavage can be targeted to the recognition sequences as described above. Any modified MT-SP1 described herein can be used in the methods of treatment including such as any MT-SP1 described above. Exemplary of modified MT-SP1 polypeptides or catalytically active portions thereof for use in the treatment provided herein include any having a sequence of amino acids set forth in any of SEQ ID NOs 12, 14, 16, 18, 20, 22, 24, 26, 28, 30, 32, 34, 36, 38, 40-69, 404-418, 419-447, 524-533, 552-659, and 663-710. In particular, an MT-SP1 polypeptide or catalytically active portion thereof for use in the treatments provided herein has a sequence of amino acids set forth in SEQ ID NOs: 596 or 650.

In any or all of the methods and uses provided herein, a non-complement protease or a catalytically active portion thereof can be administered in combination with a second agent or treatment for treating a complement-mediated disorder or any other disorder. The second agent or treatment can be administered simultaneously, sequentially or intermittently with the non-complement protease. The second agent can be administered as a separate composition or in the same composition as the non-complement protease. Exemplary of second agents are anti-inflammatory agent and anticoagulants, such as, but not limited to, any one or more of an NSAID, antimetabolite, corticosteroid, analgesic, cytotoxic agent, pro-inflammatory cytokine inhibitor, anti-inflammatory cytokines, B cell targeting agents, compounds targeting T antigens, adhesion molecule blockers, chemokines receptor antagonists, kinase inhibitors, PPAR-γ ligands, complement inhibitors, heparin, warfarin, acenocoumarol, phenindione, EDTA, citrate, oxalate, argatroban, lepirudin, bivalirudin, and ximelagatran.

Also provided are combinations of the non-complement proteases and other elements, such as reagents, second agents, and devices and containers for administering the proteases and/or agents and any other elements. The combinations can be for practicing or effecting the methods and uses provided herein. Hence provided, for example, are combinations of elements that include: (a) a non-complement protease that cleaves any one or more complement target substrates of a complement pathway such that complement activation in a pathway comprising the target substrate is altered; and (b) a second agent or agents for treating a complement-mediated disorder, such as, but not limited to anti-inflammatory agent(s) or anticoagulant(s), such as, for example, any one or more of a NSAID, antimetabolite, corticosteroid, analgesic, cytotoxic agent, pro-inflammatory cytokine inhibitor, anti-inflammatory cytokines, B cell targeting agents, compounds targeting T antigens, adhesion molecule blockers, chemokines receptor antagonists, kinase inhibitors, PPAR-γ ligands, complement inhibitors, heparin, warfarin, acenocoumarol, phenindione, EDTA, citrate, oxalate, argatroban, lepirudin, bivalirudin, and ximelagatran.

As noted, the combinations are for practicing or effecting any of the methods herein for modulating a complement pathway, such as one or more of the classical, alternative, or lectin pathways of complement. Target substrates and scaffold proteases include any of those set forth above. For example, scaffold proteases include any set forth in Table 14, and allelic variations, isoforms and catalytically active portions of the proteases set forth in Table 14. Exemplary of such proteases, include any that has or contains a sequence of amino acids set forth in any one of SEQ ID NOS: 2, 4, 8, 71, 73, 75, 77, 79, 81, 83, 85, 87, 89, 91, 93, 95, 97, 99, 101, 103, 105, 107, 109, 111, 113, 115, 117, 119, 121, 123, 125, 127, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 269, 270, 272, 274, 276, 278, 280, 282, 284, 286, 287, 289, 291, 293, 295, 297, 373, 375, 377, 379, 381, 383, 385, 387, 544, 545, 547, 549, and 551, or a catalytically active portion thereof or an allelic or species variant thereof. In some examples, the protease used in the combinations is an MT-SP1 or catalytically active portion thereof, such as an MT-SP1 set forth in SEQ ID NO: 2 or 10, and the variants noted above. As noted above, MT-SP1 protease and catalytically active portion thereof include polypeptides that contain one or more of the following modifications: F97N, F97D, F97E, F99Y, F99V, F99W, D217A, D217V, F97A, F97W, F99A, Y146N, Y146D, Y146E, Y146A, Y146W, Y146R, W215F, W215Y, Q192V, Q192R, Q192F, K224A, K224F, M180E, Y146D/K224F, D96A, Y146E/K224N, I41T/Y146E/Q175D/K224R, I41T/Y146D/K224F, I41T/Y146E/Q175D/K224N, I41T/Y146E/G151L/Q175D/K224L, Y146E/Q221aE/K224F, I41T/Y146E/G151L/Q175D/K224R, I41T/Y146E/G151L/Q175D/K224N, Q221aD, Y146E/K224R, Y146E/Q175D/K224N, Y146D/K224R, I41T/Y146E/G151L/Q175D/K224F, Y146E/Q175D/K224R, Y146E/L224L, G147E, Y146D/Q175D/K224R, Y146D/Q175L/K224L, Y146D/Q175L/K224L, Y146D/Q175W/K224L, Y146D/K224L, Y146E/Q221aE/K224R, Y146E/K224A, Y146D/Q175H/K224L, Y146D/Q175Y/K224L, Y146E/K224Y, Y146D/Q175F/K224L, Y146D/Q175F/K225L, Y146D/Q221aL/K224S, I41E/Y146D/K224L, Y146D/D217F/K224L, Y146D/D217F/K224L, H143V/Y146D/K224F, Y146E/K224F, Y146A/K224F, Y146E/K224T, I41T/Y146E/K224L, I41F/Y146D/K224F, I41L/Y146D/K224F, I41T/Y146D/G151L/K224F, I41A/Y146D/K224F, I41E/Y146D/K224F, I41D/Y146D/K224L, I41D/Y146D/K224F, Y146N/K224F, I41T/Y146D/Q175D/K224F, Q192F/K224F, Y146D/Q192A/K224F, Q192V/K224F, I41T/Y146D/Q175D/K224L, I41T/Y146D/Q175D/K224R, I41T/Y146D/Q175D/K224N, I41T/Y146D/G151L/Q175D/K224F, I41T/Y146D/G151L/Q175D/K224L, I41T/Y146D/G151L/Q175D/K224R, I41T/Y146D/G151L/Q175D/K224N, I41T/Y146E/Q175D/K224F, I41T/Y146E/Q175D/K224L, I41T/Y146D/G151L/K224N, Y146D/Q175D/K224N, Y146D/Q175D/K224N, Y146D/G151L/K224N, Y146D/Q175R/K224N, Y146D/Q175K/K224N, Y146D/Q175H/K224N, I41T/Y146D/G151L/Q175K/K224F, I41T/Y146D/G151L/Q175D/K224F, I41T/Y146D/G151L/Q175H/K224F, I41T/Y146D/G151L/Q175Y/K224F, I41T/Y146D/G151L/Q175K/K224N, I41T/Y146D/G151L/Q175R/K224N, I41T/Y146D/G151L/Q175H/K224N, and I41T/Y146D/G151L/Q175Y/K224N, based on chymotrypsin numbering. Exemplary of such modified MT-SP1 proteases, or catalytically active portions thereof, include those polypeptides having a sequence of amino acids set forth in any of SEQ ID NOS: 12, 14, 16, 18, 20, 22, 24, 26, 28, 30, 32, 34, 36, 38, 40-69, 404-418, 419-447, 524-533, 552-659, and 663-710. In particular, a modified MT-SP1 protease, or a catalytically active portion thereof, is one having a sequence of amino acids set forth in SEQ ID NOS: 596 or 650. In some cases, the modifications in an MT-SP1 protease or a catalytically active portion thereof include modifications of any one or more amino acids that contribute to extended substrate specificity or secondary sites of interaction. Exemplary of this include, but are not limited to, any that correspond to any one or more of amino acid positions 97, 146, 192, and 224 of an MT-SP1 protease, based on chymotrypsin numbering. Exemplary of such modifications are modifications in any one or more of amino acids F97, Y146, Q192, and K224 of the MT-SP1 protease, based on chymotrypsin numbering, such as modification(s) in an MT-SP1 protease or a catalytically active portion thereof are selected from any one or more of F97D, F97E, F97A, F97W, Y146N, Y146D, Y146E, Y146A, Y146W, Y146R, Q192R, Q192V, K224A, and K224F (e.g., an MT-SP1 protease or a catalytically active portion thereof corresponds to a modified MT-SP1 polypeptide having a sequence of amino acids as set forth in any of SEQ ID NOS: 16, 18, 20, 22, 24, 26, 28, 30, 32, 34, 36, 14, 38, and 40 and 405-418 and/or in an MT-SP1 protease or a catalytically active portion thereof with modifications at positions Y146D and K224F or Y146E, such as those modified MT-SP1 polypeptides having a sequence of amino acids as set forth in SEQ ID NO:12, 404, 28 or 412).

In the combinations and methods and uses provided herein, the non-complement protease can cleave a substrate recognition site of the target substrate. Exemplary recognition sites are set forth above.

Also provided are particular modified non-complement proteases. For example provided are non-complement proteases containing modifications in any one or more amino acids of a scaffold protease, where the modified amino acid residue(s) increases one or both of specificity for a target substrate or activity towards a target substrate, where the target substrate is a complement protein, such as any target substrate and mixture thereof and source thereof set forth above. The modified non-complement protease includes any suitable scaffold including any noted above, such as a scaffold protease selected from among granzyme B, granzyme A, granzyme M, cathepsin G, MT-SP1, neutrophil elastase, chymase, alpha-tryptase, beta-tryptase I or II, chymotrypsin, collagenase, factor XII, factor XI, factor CII, factor X, thrombin, protein C, u-plasminogen activator (u-PA), t-plasminogen activator (t-PA), plasmin, plasma kallikrein, chymotrypsin, trypsin, a cathepsin, papain, cruzain, a metalloprotease and allelic variations, isoforms and catalytically active portions thereof. Target substrates include any set forth above, such as, but not limited to C2 and/or C3.

Exemplary modified non-complement proteases include those based on an MT-SP1 scaffold (full-length or a catalytically active portion thereof). The MT-SP1 scaffold can include one, or at least two or more modifications, where one modification is at position 146 and the second modification is at position 224, based on chymotrypsin numbering, provided that:
(i) where the protease includes only two modifications, the protease does not include Y146D and K224F as the two modifications; and (ii) where the protease contains three modifications, the protease does not include F99V or I or L or T with Y146D and K224F. For example, such modified non-complement proteases can include one containing at least two or more modifications, where one modification is a position 146 and the second is at position 224, based on chymotrypsin numbering, provided that: (i) where the protease includes only two modifications, the protease does not include Y146D and K224F as the two modifications; and (ii) where the protease contains three modifications, the protease does not include F99V or I or L or T with Y146D and K224F. An MT-SP1 protease, or catalytically portion thereof, also includes a modified protein containing one, or at least two or more modifications at position 151 and/or position 41. Exemplary of any of the above modified MT-SP1 proteases or catalytically active portions thereof include a modified MT-SP1 containing modifications of any of I41T/Y146D/G151L/K224F, I41T/Y146D/G151L/Q175D/K224F, I41T/Y146D/G151L/Q175D/K224L, I41T/Y146D/G151L/Q175D/K224R, AND I41T/Y146D/G151L/Q175D/K224N, I41T/Y146D/G151L/K224N, Y146D/G151L/K224N, I41T/Y146D/G151L/Q175K/K224F, I41T/Y146D/G151L/Q175R/K224F, I41T/Y146D/G151L/Q175H/K224F, I41T/Y146D/G151L/Q175Y/K224F, I41T/Y146D/G151L/Q175K/K224N, I41T/Y146D/G151L/Q175R/K224N, I41T/Y146D/G151L/Q175H/K224N, and I41T/Y146D/G151L/Q175Y/K224N based on chymotrypsin numbering.

Exemplary of such modified proteases include an MT-SP1 protease or a catalytically active portion thereof having a modification selected from any one or more of D96A, D96V, D96F, D96F, D96S, D96T, F99S, F99G, Q174H, Q174A, Q174V, Q174F, Q174R, Q174K, Q174L, Q174Y, Q192L, Q192I, Q192E, Q192K, Q192Y, D217Q, D217N, D217H, K224A, based on chymotrypsin numbering. Exemplary are MT-SP1 proteases that contain or have a sequence of amino acids as set forth in any one of SEQ ID NOS: 41-51, 56, 57, 60-64, 67, 419-429, 431, 434, 435, 438-442, and 445.

Exemplary modified MT-SP1 proteases, or catalytically active portion thereof, also include any having any of the following modifications: Y146E/K224N, I41T/Y146E/Q175D/K224R, I41T/Y146D/K224F, I41T/Y146E/Q175D/K224N, I41T/Y146E/G151L/Q175D/K224L, Y146E/Q221aE/K224F, I41T/Y146E/G151L/Q175D/K224R, I41T/Y146E/G151L/Q175D/K224N, Q221aD, Y146E/K224R, Y146E/Q175D/K224N, Y146D/K224R, I41T/Y146E/G151L/Q175D/K224F, Y146E/Q175D/K224R, Y146E/L224L, G147E, Y146D/Q175D/K224R, Y146D/Q175L/K224L, Y146D/Q175L/K224L, Y146D/Q175W/K224L, Y146D/K224L, Y146E/Q221aE/K224R, Y146E/K224A, Y146D/Q175H/K224L, Y146D/Q175Y/K224L, Y146E/K224Y, Y146D/Q175F/K224L, Y146D/Q175F/K225L, Y146D/Q221aL/K224S, I41E/Y146D/K224L, Y146D/D217F/K224L, Y146D/D217F/K224L, H143V/Y146D/K224F, Y146E/K224F, Y146A/K224F, Y146E/K224T, I41T/Y146E/K224L, I41F/Y146D/K224F, I41L/Y146D/K224F, I41T/Y146D/G151L/K224F, I41A/Y146D/K224F, I41E/Y146D/K224F, I41D/Y146D/K224L, I41D/Y146D/K224F, Y146N/K224F, I41T/Y146D/Q175D/K224F, Q192F/K224F, Y146D/Q192A/K224F, Q192V/K224F, I41T/Y146D/Q175D/K224L, I41T/Y146D/Q175D/K224R, I41T/Y146D/Q175D/K224N, I41T/Y146D/G151L/Q175D/

K224F, I41T/Y146D/G151L/Q175D/K224L, I41T/Y146D/ G151L/Q175D/K224R, I41T/Y146D/G151L/Q175D/ K224N, I41T/Y146E/Q175D/K224F, and I41T/Y146E/ Q175D/K224L, I41T/Y146D/G151L/K224N, Y146D/ Q175D/K224N, Y146D/Q175D/K224N, Y146D/G151L/ K224N, Y146D/Q175R/K224N, Y146D/Q175K/K224N, Y146D/Q175H/K224N, I41T/Y146D/G151L/Q175K/ K224F, I41T/Y146D/G151L/Q175R/K224F, I41T/Y146D/ G151L/Q175H/K224F, I41T/Y146D/G151L/Q175Y/ K224F, I41T/Y146D/G151L/Q175K/K224N, I41T/Y146D/ G151L/Q175R/K224N, I41T/Y146D/G151L/Q175H/ K224N, and I41T/Y146D/G151L/Q175Y/K224N, based on chymotrypsin numbering. Exemplary of such proteases are any having a sequence of amino acids set forth in any of SEQ ID NOS: 41-51, 56, 57, 60-64, 67, 69, 419-429, 431, 434, 435, 438-442, 445, 524, 525, 527-530, 532, 533, 552-659, or 663-710. In particular, a modified MT-SP1 protease or catalytically active portion thereof has a sequence of amino acids set forth in SEQ ID NOS: 596 or 650. Included among the modified MT-SP1 proteases, or catalytically active portions thereof, provided herein are those that cleave a target substrate, typically, at a substrate recognition site in the target substrate. Exemplary of target substrates include C2 or C3. Cleavage of C2 can be at a substrate recognition site SLGR (SEQ ID NO: 392) in C2.

Among the modified non-complement proteases that contain modifications in any one or more amino acids of a scaffold protease, where the modified amino acid residue(s) increases one or both of specificity for a target substrate or activity towards a target substrate, wherein the target substrate is a complement protein that are provided are such modified non-complement proteases that not cleave a VEGF or VEGFR or that exhibit a reduction in any cleavage activity of a VEGF or VEGFR or that exhibit greater substrate specificity or activity for a target substrate such as a complement protein, than for VEGF or VEGFR with the modification compared to without the modification. For example, the non-complement protease cleaves a complement protein with at least or about 1-fold, 1.5-fold, 2-fold, 5-fold, 10-fold, 20-fold, 50-fold, 100-fold, 200-fold, 500-fold, 1000-fold, or more greater specificity or activity than it cleaves VEGF or VEGFR. The target substrates include complement proteins, such as, but not limited to any one or more of C1q, C2, C3, iC3, C4, iC4, C5, C6, C7, C8, C9, MBL, Factor B, Factor D, Factor P, MASP-1, MASP-2, C1r, C1s, C4b, C4a, C2b, C2a, C3b, C3a, Ba, Bb and ficolin. Exemplary target substrates include, but are not limited to target substrates containing a sequence of amino acids set forth in any one of SEQ ID NOS: 298, 299, 300, 302, 304, 305, 306, 311, 312, 313, 314, 315, 316, 317, 318, 319, 320, 321, 322, 326, 328, 330, 332, 334, 335, 338, 340 and 344 or a fragment thereof that exhibits a complement activity.

Scaffold proteases include any protease, including, a serine protease, cysteine protease, aspartic protease, threonine protease, or metallo-protease, such as any set forth in Table 14, and allelic and species variants thereof, isoforms and catalytically active portions, and modified forms thereof that have 60, 65, 70, 75, 80, 85, 90, 95, 96, 97, 98, 99% or more sequence identity to any provided in the Table or elsewhere herein, such as a scaffold protease that contains a sequence of amino acids as set forth in any one of SEQ ID NOS: 2, 4, 8, 71, 73, 75, 77, 79, 81, 83, 85, 87, 89, 91, 93, 95, 97, 99, 101, 103, 105, 107, 109, 111, 113, 115, 117, 119, 121, 123, 125, 127, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 269, 270, 272, 274, 276, 278, 280, 282, 284, 286, 287, 289, 291, 293, 295, 297, 373, 375, 377, 379, 381, 383, 385, 387, 544, 545, 547, 549, and 551, and catalytically active portions thereof. The scaffolds can be used for preparing modified proteases and in any method or use herein. As discussed above, MT-SP1 or a catalytically active fragment thereof is exemplary of such proteases. An exemplary MT-SP1 protease or portion thereof has the sequence of amino acids set forth in SEQ ID NO: 2 or 10. Modifications include any that alter substrate specificity or selectivity, particularly those that increase substrate specificity or selectivity for a complement protein. Exemplary of such modifications are MT-SP1 proteases or a catalytically active portions thereof with any of the following modifications D96A, D96V, D96F, D96F, D96S, D96T, F97D, F97E, F97A, F97W, F99A, F99S, F99G, F99W, F99Y, Y146N, Y146D, Y146E, Y146A, Y146W, Y146R, Q174H, Q174A, Q174V, Q174F, Q174R, Q174K, Q174L, Q174Y, M180E, Q192R, Q192V, Q192L, Q192I, Q192F, Q192E, Q192K, Q192Y, W215F, W215Y, D217Q, D217N, D217H, D217A, D217V, K224A, Y146E/K224N, I41T/Y146E/Q175D/K224R, I41T/Y146D/K224F, I41T/Y146E/Q175D/K224N, I41T/Y146E/G151L/Q175D/K224L, Y146E/Q221aE/K224F, I41T/Y146E/G151L/Q175D/K224R, I41T/Y146E/G151L/Q175D/K224N, Q221aD, Y146E/K224R, Y146E/Q175D/K224N, Y146D/K224R, I41T/Y146E/G151L/Q175D/K224F, Y146E/Q175D/K224R, Y146E/L224L, G147E, Y146D/Q175D/K224R, Y146D/Q175L/K224L, Y146D/Q175L/K224L, Y146D/Q175W/K224L, Y146D/K224L, Y146E/Q221aE/K224R, Y146E/K224A, Y146D/Q175H/K224L, Y146D/Q175Y/K224L, Y146E/K224Y, Y146D/Q175F/K224L, Y146D/Q175F/K225L, Y146D/Q221aL/K224S, I41E/Y146D/K224L, Y146D/D217F/K224L, Y146D/D217F/K224L, H143V/Y146D/K224F, Y146E/K224F, Y146A/K224F, Y146E/K224T, I41T/Y146E/K224L, I41F/Y146D/K224F, I41L/Y146D/K224F, I41T/Y146D/G151L/K224F, I41A/Y146D/K224F, I41E/Y146D/K224F, I41D/Y146D/K224L, I41D/Y146D/K224F, Y146N/K224F, I41T/Y146D/Q175D/K224F, Q192F/K224F, Y146D/Q192A/K224F, Q192V/K224F, I41T/Y146D/Q175D/K224L, I41T/Y146D/Q175D/K224R, I41T/Y146D/Q175D/K224N, I41T/Y146D/G151L/Q175D/K224F, I41T/Y146D/G151L/Q175D/K224L, I41T/Y146D/G151L/Q175D/K224R, I41T/Y146D/G151L/Q175D/K224N, I41T/Y146E/Q175D/K224F, and I41T/Y146E/Q175D/K224L, I41T/Y146D/G151L/K224N, Y146D/Q175D/K224N, Y146D/Q175D/K224N, Y146D/G151L/K224N, Y146D/Q175R/K224N, Y146D/Q175K/K224N, Y146D/Q175H/K224N, I41T/Y146D/G151L/Q175K/K224F, I41T/Y146D/G151L/Q175R/K224F, I41T/Y146D/G151L/Q175H/K224F, I41T/Y146D/G151L/Q175Y/K224F, I41T/Y146D/G151L/Q175K/K224N, I41T/Y146D/G151L/Q175R/K224N, I41T/Y146D/G151L/Q175H/K224N, and I41T/Y146D/G151L/Q175Y/K224N, based on chymotrypsin numbering.

and allelic and species variants and isoforms thereof and variants with 60, 65, 70, 75, 80, 85, 90, 95, 96, 97, 98, 99% or more sequence identity therewith and including the corresponding modification. For example, modified MT-SP1 polypeptide containing a sequence of amino acids as set forth in any of SEQ ID NOS: 41-51, 56, 57, 60-64, 67, 69, 419-429, 431, 434, 435, 438-442, 445, 524, 525, 527-530, 532, 533, 552-659, or 663-710.

Also provided are pharmaceutical compositions containing any of the modified non-complement proteases or elements of the combinations provided herein. The pharmaceutical compositions include, as needed, pharmaceutically acceptable excipients and other components. The compositions are formulated for any desired or suitable route of administration, including, but not limited to systemic, oral, nasal, pulmonary, local, or topical administration.

Kits are provided. The kits can be used in practicing the methods. Kits containing the combinations are provided. Kits containing the pharmaceutical compositions also are provided. The kits also can contain devices for administration of the composition and/or proteases and, optionally, instructions for administration and other reagents and products employed in the methods.

Also provided are nucleic acid molecules that encode any of the modified non-complement proteases. Included among these are nucleic acid molecules that encode or that hybridize under medium or high stringency to any nucleic acid that encodes any of the polypeptides set forth in any of SEQ ID NOS: 12, 14, 16, 18, 20, 22, 24, 26, 28, 30, 32, 34, 36, 38, 40-69, 404-418, 419-447, 524-533, 552-659, or 663-710. Also included among the nucleic acid molecules are those selected from among:

a) a nucleic acid molecule comprising a sequence of nucleotides set forth in any of SEQ ID NOS: 11, 13, 15, 17, 19, 21, 23, 25, 27, 29, 31, 33, 35, 37, 451-455, 457-462, 464-479, and 534-538;

b) a nucleic acid molecule comprising at least 60, 65, 70, 75, 80, 85, 90, 91, 92, 93, 94, 95, 96, 97, 98, 99% sequence identity to any of SEQ ID NOS: 11, 13, 15, 17, 19, 21, 23, 25, 27, 29, 31, 33, 35, 37, 451-455, 457-462, 464-479, 534-538;

c) a nucleic acid that hybridizes under conditions of medium or high stringency along at least 70% of its full length to a nucleic acid molecule comprising a sequence of nucleotides set forth in any of SEQ ID NOS: 11, 13, 15, 17, 19, 21, 23, 25, 27, 29, 31, 33, 35, 37, 451-455, 457-462, 464-479, 534-538;

d) a nucleic acid molecule that comprises degenerate codons of a), b), or c); or e) a nucleic acid molecule comprising splice variants or allelic variants of any of SEQ ID NOS: 11, 13, 15, 17, 19, 21, 23, 25, 27, 29, 31, 33, 35, 37, 451-455, 457-462, 464-479, 534-538 or any of a)-d).

Also included are nucleic acid molecules selected from among:

a) a nucleic acid molecule comprising a sequence of nucleotides set forth in any of SEQ ID NOS: 480-493, 495-499, 501-506, 508-523, 539-543;

b) a nucleic acid molecule comprising at least 60, 65, 70, 75, 80, 85, 90, 91, 92, 93, 94, 95, 96, 97, 98, 99% sequence identity to any of SEQ ID NOS: 480-493, 495-499, 501-506, 508-523, 539-543;

c) a nucleic acid that hybridizes under conditions of medium or high stringency along at least 70% of its full length to a nucleic acid molecule comprising a sequence of nucleotides set forth in any of SEQ ID NOS: 480-493, 495-499, 501-506, 508-523, 539-543;

d) a nucleic acid molecule that comprises degenerate codons of a), b), or c); or e) a nucleic acid molecule comprising splice variants or allelic variants of any of SEQ ID NOS: 480-493, 495-499, 501-506, 508-523, 539-543 or any of a)-d).

Vectors containing the nucleic acid molecules. Vectors include eukaryotic and prokaryotic expression vectors, including mammalian and yeast vectors. Cells containing the nucleic acid molecules and/or vectors also are provided.

Exemplary expression vector include but are not limited to: an adenovirus vector, an adeno-associated virus vector, EBV, SV40, cytomegalovirus vector, vaccinia virus vector, herpesvirus vector, a retrovirus vector, a lentivirus vector and an artificial chromosome. Methods for production or preparation of the encoded non-complement proteases are provided. The vectors or nucleic acid molecules are introduced into cells and cultured under conditions, whereby the protease is expressed. The nucleic acid molecule can include sequence encoded a signal sequence to direct trafficking of the expressed protease, such as a signal sequence for secretion. The expressed proteases can be purified by routine methods known to those of skill in the art.

Methods of treatment by administering to a subject a nucleic acid molecule, vector or cell are provided. The diseases treated include any mediated by or involving a complement protein or the complement pathway, such as diseases with an underlying inflammatory component or pathology. Vectors include an expression vector that integrated into a host cell's chromosome or a vector that remains episomal. Administration can be in vivo or ex vivo. Ex vivo treatment includes administering the nucleic acid into a cell in vitro, followed by administration of the cell into the subject. The cell can be from a suitable (compatible) donor or from the subject, such as a human, to be treated.

Also provided are fusion proteins containing a catalytically active portion of any of the non-complement proteases that is fused to a non-protease polypeptide. Fusion can be by insertion into the non-protease polypeptide or linkage at either end.

BRIEF DESCRIPTION OF THE FIGURE

FIG. 1 depicts an overview of the classical, lectin, and alternative complement pathways and the activation of the terminal complement complex, the membrane attack complex (MAC). In particular, the FIGURE depicts many of the more than 30 proteins that participate in the complement cascade, their action within the cascade, and where applicable, their points of convergence among the complement pathways. For example, the three pathways converge upon the generation of a C3 convertase, which cleaves C3 to form a C5 convertase yielding the formation of the MAC complex. The FIGURE also depicts the generation of many of the complement cleavage products. All proteins depicted in the pathways can serve as substrate targets.

DETAILED DESCRIPTION

Outline
  A. Definitions
  B. TARGET: COMPLEMENT
    1. Nomenclature
    2. Pathways of Complement Initiation
      a. Classical
      b. Alternative
      c. Lectin
    3. Complement-mediated effector functions
      a. Complement-mediated lysis: Membrane Attack Complex
      b. Inflammation
      c. Chemotaxis
      d. Opsonization
      e. Activation of the Humoral Immune Response 4. Complement Receptors
5. Complement Regulation
   a. Factor I
6. Complement-Mediated Disease
   a. Disease mediated by complement activation
      i. Rheumatoid Arthritis
      ii. Sepsis
      iii. Multiple Sclerosis
      iv. Alzheimer's Disease
      v. Ischemia-Reperfusion Injury
   b. Disease mediated by complement deficiency
C. PROTEASES
   1. Classes of proteases
      a. Serine Proteases
         i. MT-SP1
         ii. Granzyme B
      b. Cysteine Proteases
      c. Aspartic Proteases
      d. Metalloproteases
      e. Threonine Proteases
D. SCAFFOLD PROTEASES
   1. Modified Scaffold Proteases
      a. Rational Modification
         i. Synthesis of Positional Scanning Libraries and Screening using Fluorescence
      b. Empirical Modification
   2. Methods of assessing specificity
   3. Protease polypeptides
      a. MT-SP1 polypeptides
E. Assays to assess or monitor modified protease activity on complement-mediated functions
   a. Protein Detection
      i. SDS-PAGE
      ii. Enzyme Immunoassay
      iii. Radial Immunodiffusion (RID)
   b. Hemolytic assays
F. Methods of producing nucleic acids encoding modified proteases and methods of producing modified protease polypeptides
   1. Vectors and Cells
   2. Expression
      a. Prokaryotes
      b. Yeast
      c. Insect cells
      d. Mammalian cells
      e. Plants
   3. Purification Techniques
   4. Fusion Proteins
   5. Nucleotide sequences
G. METHODS OF USING: Formulations/Packaging/Administration
   1. Administration of modified protease polypeptides
   2. Administration of nucleic acids encoding modified protease polypeptide (gene therapy)
H. THERAPEUTIC USES
   1. Immune-mediated Inflammatory Disease
   2. Neurodegenerative Disease
   3. Cardiovascular Disease
I. COMBINATION THERAPIES
J. EXAMPLES

A. DEFINITIONS

Unless defined otherwise, all technical and scientific terms used herein have the same meaning as is commonly understood by one of skill in the art to which the invention(s) belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, MBL (mannose binding lectin) also is designated mannose-binding protein (MBP).

As used herein, complement activation refers to the sequential activation of serum components C1 through C9, initiated by a variety of activators including, for example, antigen-antibody complex, lipopolysaccharide, or microbial polysaccharides, and producing an inflammatory response via any pathway.

As used herein, a "complement protein" or a "complement component" is a protein of the complement system that functions in the host defense against infections and in the inflammatory process. Complement proteins constitute target substrates for the proteases and modified proteases provided herein.

Complement proteins are a group of interacting blood proteins and glycoproteins found in all vertebrates. There are at least 30 soluble plasma proteins in addition to cell surface receptors that bind complement reaction products and that occur on inflammatory cells and cells of the immune system. In addition, there are regulatory membrane proteins that protect host cells from accidental complement attack. Complement proteins include those that function in the classical pathway, for example, C2, those that function in the alternative pathway, for example, Factor B, and those that function in the lectin pathway, for example MASP-1. Among the complement proteins are proteases that participate in the complement pathways. In addition, as used herein, complement proteins include any of the "cleavage products" (also referred to as "fragments") that are formed upon activation of the complement cascade. Also included among complement proteins are inactive or altered forms of complement proteins, such as iC3 and C3a-desArg.

Thus, complement proteins include, but are not limited to: C1q, C1r, C1s, C2, C3, C3a, C3b, C3c, C3dg, C3g, C3d, C3f, iC3, C3a-desArg, C4, C4a, C4b, iC4, C4a-desArg, C5, C5a, C5a-des-Arg, C6, C7, C8, C9, MASP-1, MASP-2, MBL, Factor B, Factor D, Factor H, Factor I, CR1, CR2, CR3, CR4, properdin, C1Inh, C4 bp, MCP, DAF, CD59 (MIRL), clusterin and HRF and allelic and species variants of any complement protein.

As used herein, a "native" form of a complement protein is one which can be isolated from an organism such as a vertebrate in the absence of complement activation, and which has not been intentionally modified by man in the laboratory. Examples of native complement proteins include C1q, C1r, C1s, C2, C3, C4, Factor B, Factor D, properdin, C5, C6, C7, C6, and C9.

Generally, native complement proteins are inactive and acquire activity upon activation. Activation can require activation cleavage, maturation cleavage and/or complex formation with other proteins. An exception to this is Factor I and Factor D which have enzymatic activity in their native form. In some examples, activation of a native complement protein occurs following cleavage of the protein. For example, complement zymogens such as C2 and Factor B are proteases which are themselves activated by protease cleavage such that cleavage of C2 by the protease C1s generates C2b which associates with C4b to form the proteolytically active C4b2b (C3 convertase) and cleavage of Factor B by the protease Factor D generates Bb which associates with C3b to form the proteolytically active alternative C3 convertase, C3bBb. In another example, cleavage of an inactive native complement protein results in changes in the structural stability of a protein resulting in activation of the protein. For example, C3 and C4 contain an internal thioester bond which in the native protein is stable, but can become highly reactive and activated following conformational changes that result from cleavage of the protein. Thus, the cleavage products of C3 and C4 are biologically active. Activation of C3 and C4 also can occur spontaneously in the absence of cleavage. It is the spontaneous conversion of the thioester bond in native C3 that is an initiating event of the alternative pathway of complement. In other example, activation of a native complement protein occurs following the release of a complexed regulatory molecule that inhibits the activity of an otherwise active native complement protein. For example, C1inh binds to and inactivates C1s and C1r, unless they are in complex with C1q.

As used herein, maturation cleavage is a general term that refers to any cleavage required for activation of a zymogen. This includes cleavage that leads to a conformational change resulting in activity (i.e. activation cleavage). It also includes cleavage in which a critical binding site is exposed or a steric hindrance is exposed or an inhibitory segment is removed or moved.

As used herein, altered form of a complement protein refers to a complement protein that is present in a non-native form resulting from modifications in its molecular structure. For example, C3 reaction of the thioester with water can occur in the absence of convertase cleavage, giving a hydrolyzed inactive form of C3 and C4 termed iC3 and iC4. In another example, anaphylatoxins including C3a, C5a, and C4a can be designated by carboxypeptidase N into more stable, less active forms.

As used herein, a "fragment" or "cleavage product" of a complement protein is a subset of a complement protein that contains a portion of the polypeptide sequence of a native complement protein. A fragment of a complement protein usually results following the activation of any one or more, such as 1, 2 or 3, of the complement cascades. Generally, a fragment results from the proteolytic cleavage of a native complement protein. For example, Factor B is enzymatically cleaved by Factor D, resulting in two fragments: Ba which constitutes the N-terminal portion of B; and Bb which constitutes the C-terminal portion and contains the serine protease site. A fragment of a complement protein also results from the proteolytic cleavage of another fragment of a complement protein. For example, C3b, a fragment generated from the cleavage of C3, is cleaved by Factor I to generate the fragments iC3b and C3f. Generally cleavage products of complement proteins are biologically active products and function as cleavage effector molecules of the complement system. Hence a fragment or portion of complement protein includes cleavage products of complement proteins and also portions of the proteins that retain or exhibit at least one activity.

As used herein, "cleavage effector molecules" or "cleavage effector proteins" refers to the active cleavage products generated as a result of the triggered-enzyme cascade of the complement system. A cleavage effector molecule, a fragment or cleavage product resulting from complement activation can contribute to any of one or more of the complement-mediated functions or activities, which include opsonization, anaphylaxis, cell lysis and inflammation. Examples of cleavage or effector molecules include, but are not limited to, C3a, C3b, C4a, C4b, C5a, C5b-9, and Bb. Cleavage effector molecules of the complement system, by virtue of participation in the cascade, exhibit activities that include stimulating inflammation, facilitating antigen phagocytosis, and lysing some cells directly. Complement cleavage products promote or participate in the activation of the complement pathways.

As used herein, anaphylatoxins (such as, for example, C3a, C4a or C5a) are cleavage effector proteins that trigger degranulation of (release of substances from) mast cells or basophils, which participate in the inflammatory response, particularly as part of defense against parasites. If the degranulation is too strong, it can cause allergic reactions. Anaphylatoxins also indirectly mediate spasms of smooth muscle cells (such as bronchospasms), an increase in permeability of blood capillaries, and chemotaxis.

As used herein, chemotaxis refers to receptor-mediated movement of leukocytes towards a chemoattractant typically in the direction of the increasing concentration thereof, such as in the direction of increasing concentration of an anaphylatoxin.

As used herein, opsonization refers to the alteration of the surface of a pathogen or other particle so that it can be ingested by phagocytes. A protein that binds or alters the surface of a pathogen is termed an opsonin. Antibody and complement proteins opsonize extracellular bacteria for uptake and destruction by phagocytes such as neutrophils and macrophages.

As used herein, cell lysis refers to the breaking open of a cell by the destruction of its wall or membrane. Hemolysis of red blood cells is a measure of cell lysis.

As used herein, "proteases," "proteinases" and "peptidases" are interchangeably used to refer to enzymes that catalyze the hydrolysis of covalent peptidic bonds. These designations include zymogen forms and activated single-, two- and multiple-chain forms thereof. For clarity, reference to proteases refer to all forms. Proteases include, for example, serine proteases, cysteine proteases, aspartic proteases, threonine and metallo-proteases depending on the catalytic activity of their active site and mechanism of cleaving peptide bonds of a target substrate.

As used herein, a zymogen refers to a protease that is activated by proteolytic cleavage, including maturation cleavage, such as activation cleavage, and/or complex formation with other protein(s) and/or cofactor(s). A zymogen is an inactive precursor of a proteolytic enzyme. Such precursors are generally larger, although not necessarily larger, than the active form. With reference to serine proteases, zymogens are converted to active enzymes by specific cleavage, including catalytic and autocatalytic cleavage, or by binding of an activating co-factor, which generates an active enzyme. A zymogen, thus, is an enzymatically inactive protein that is converted to a proteolytic enzyme by the action of an activator. Cleavage can be effected autocatalytically. A number of complement proteins are zymogens; they are inactive, but become cleaved and activated upon the initiation of the complement system following infection. Zymogens, generally, are inactive and can be converted to mature active polypeptides by catalytic or autocatalytic cleavage of the proregion from the zymogen.

As used herein, a "proregion," "propeptide," or "pro sequence," refers to a region or a segment that is cleaved to produce a mature protein. This can include segments that function to suppress enzymatic activity by masking the catalytic machinery and thus preventing formation of the catalytic intermediate (i.e., by sterically occluding the substrate binding site). A proregion is a sequence of amino acids positioned at the amino terminus of a mature biologically active polypeptide and can be as little as a few amino acids or can be a multidomain structure.

As used herein, an activation sequence refers to a sequence of amino acids in a zymogen that is the site required for activation cleavage or maturation cleavage to form an active protease. Cleavage of an activation sequence can be catalyzed autocatalytically or by activating partners.

Activation cleavage is a type of maturation cleavage in which a conformational change required for activity occurs. This is a classical activation pathway, for example, for serine proteases in which a cleavage generates a new N-terminus which interacts with the conserved regions of catalytic machinery, such as catalytic residues, to induce conformational changes required for activity. Activation can result in production of multi-chain forms of the proteases. In some instances, single chain forms of the protease can exhibit proteolytic activity as a single chain.

As used herein, domain refers to a portion of a molecule, such as proteins or the encoding nucleic acids, that is structurally and/or functionally distinct from other portions of the molecule and is identifiable.

As used herein, a protease domain is the catalytically active portion of a protease. Reference to a protease domain of a protease includes the single, two- and multi-chain forms of any of these proteins. A protease domain of a protein contains all of the requisite properties of that protein required for its proteolytic activity, such as for example, its catalytic center.

As used herein, a catalytically active portion of a protease refers to the protease domain, or any fragment or portion thereof that retains protease activity. Significantly, at least in vitro, the single chain forms of the proteases and catalytic domains or proteolytically active portions thereof (typically C-terminal truncations) exhibit protease activity.

As used herein, a "nucleic acid encoding a protease domain or catalytically active portion of a protease" refers to a nucleic acid encoding only the recited single chain protease domain or active portion thereof, and not the other contiguous portions of the protease as a continuous sequence.

As used herein, recitation that a polypeptide consists essentially of the protease domain means that the only portion of the polypeptide is a protease domain or a catalytically active portion thereof. The polypeptide can optionally, and generally will, include additional non-protease-derived sequences of amino acids.

As used herein, "S1-S4" refers to amino acid residues that form the binding sites for P1-P4 residues of a substrate (see, e.g., Schecter and Berger (1967) *Biochem Biophys Res Commun* 27:157-162). Each of S1-S4 contains one, two or more residues, which can be non-contiguous. These sites are numbered sequentially from the recognition site N-terminal to the site of proteolysis, referred to as the scissile bond.

As used herein, the terms "P1-P4" and "P1'-P4'" refer to the residues in a substrate peptide that specifically interact with the S1-S4 residues and S1'-S4'residues, respectively, and are cleaved by the protease. P1-P4 refer to the residue positions on the N-terminal side of the cleavage site; P1'-P4' refer to the residue positions to the C-terminal side of the cleavage site. Amino acid residues are labeled from N to C termini of a polypeptide substrate (Pi, . . . , P3, P2, P1, P1', P2', P3', . . . , Pj). The respective binding subsites are labeled (Si, . . . , S3, S2, S1, S1', S2', S3', . . . , Sj). The cleavage is catalyzed between P1 and P1.'

As used herein, a "binding pocket" refers to the residue or residues that interact with a specific amino acid or amino acids on a substrate. A "specificity pocket" is a binding pocket that contributes more energy than the others (the most important or dominant binding pocket). Typically, the binding step precedes the formation of the transition state that is necessary for the catalytic process to occur. S1-S4 and S1'-S4' amino acids make up the substrate sequence binding pocket and facilitate substrate recognition by interaction with P1-P4 and P1'-P4' amino acids of a peptide, polypeptide or protein substrate, respectively. Whether a protease interacts with a substrate is a function of the amino acids in the S1-S4 and S1'-S4' positions. If the amino acids in any one or more of the S1, S2, S3, S4, S1', S2', S3' and S4' subsites interact with or recognize any one or more of the amino acids in the P1, P2, P3, P4, P1', P2', P3' and P4' sites in a substrate, then the protease can cleave the substrate. A binding pocket positions a target amino acid with a protease so that catalysis of a peptide bond and cleavage of a substrate is achieved. For example, serine proteases typically recognize P4-P2' sites in a substrate; others proteases can have extended recognition beyond P4-P2'.

As used herein, amino acids that "contribute to extended substrate specificity" refers to those residues in the active site cleft in addition to the specificity pocket. These amino acids include the S1-S4, S1'-S4' residues in a protease.

As used herein, secondary sites of interaction are outside the active site cleft. These can contribute to substrate recognition and catalysis. These amino acids include amino acids that can contribute second and third shell interactions with a substrate. For example, loops in the structure of a protease surrounding the S1-S4. S1'-S4' amino acids play a role in positioning P1-P4, P1'-P4' amino acids in the substrate thereby registering the scissile bond in the active site of a protease.

As used herein, active site of a protease refers to the substrate binding site where catalysis of the substrate occurs. The structure and chemical properties of the active site allow the recognition and binding of the substrate and subsequent hydrolysis and cleavage of the scissile bond in the substrate. The active site of a protease contains amino acids that contribute to the catalytic mechanism of peptide cleavage as well as amino acids that contribute to substrate sequence recognition, such as amino acids that contribute to extended substrate binding specificity.

As used herein, a catalytic triad of a serine or cysteine protease refers to a combination of three amino acids that are in the active site of a serine or cysteine protease and contribute to the catalytic mechanism of peptide cleavage. Generally, a catalytic triad is found in serine proteases and provides an active nucleophile and acid/base catalysis. The catalytic triad of serine proteases contains three amino acids, which in chymotrypsin are $Asp^{102}$, $His^{57}$, and $Ser^{195}$. These residues are critical for the catalytic efficiency of a serine protease.

As used herein, the "substrate recognition site" or "cleavage sequence" refers to the sequence recognized by the active site of a protease that is cleaved by a protease. Typically, for example, for a serine protease, a cleavage sequence is made up of the P1-P4 and P1'-P4' amino acids in a substrate, where cleavage occurs after the P1 position. Typically, a cleavage sequence for a serine protease is six residues in length to match the extended substrate specificity of many proteases, but can be longer or shorter depending upon the protease. For example, the substrate recognition site or cleavage sequence of MT-SP1 required for autocatalysis is RQARVV (SEQ ID NO: 711), where R is at the P4 position, Q is at the P3 position, A is at the P2 position and R is at the P1 position. Cleavage in MT-SP1 occurs after position R followed by the sequence VVGG (SEQ ID NO: 712).

As used herein, target substrate refers to a substrate that is cleaved by a protease. Typically, the target substrate is specifically cleaved at its substrate recognition site by a protease. Minimally, a target substrate includes the amino acids that make up the cleavage sequence. Optionally, a target substrate includes a peptide containing the cleavage sequence and any other amino acids. A full-length protein, allelic variant, isoform, or any portion thereof, containing a cleavage sequence recognized by a protease, is a target substrate for that protease. For example, for purposes herein in which complement inactivation is intended, a target substrate is any one or more, such as for example, 1, 2, 3, 4, 5, 6, 7, 8, 9, 10, 20, 30, 40 or more, complement proteins, or any portion or fragment thereof of a complement protein containing a cleavage sequence recognized by a protease. Such target substrates can be purified proteins, or can be present in a mixture, such as a mixture in vitro or a mixture in vivo. Mixtures can include, for example, blood or serum, or other tissue fluids. Additionally, a target substrate includes a peptide or protein containing an additional moiety that does not affect cleavage of the substrate by a protease. For example, a target substrate can include a four amino acid peptide or a full-length protein chemically linked to a fluorogenic moiety. The proteases can be modified to exhibit greater substrate specificity for a target substrate.

As used herein, cleavage refers to the breaking of peptide bonds by a protease. The cleavage site motif for a protease involves residues N- and C-terminal to the scissile bond (the unprimed and primed sides, respectively, with the cleavage site for a protease defined as . . . P3-P2-P1-P1'-P2'-P3' . . . , and cleavage occurs between the P1 and P1' residues). Typically, cleavage of a substrate is an activating cleavage or an inhibitory cleavage. An activating cleavage refers to cleavage of a polypeptide from an inactive form to an active form. This includes, for example, cleavage of a zymogen to an active enzyme, and/or cleavage of a pro-growth factor into an active growth factor. For example, MT-SP1 can auto-activate by cleaving a target substrate at the P1-P4 sequence of RQAR (SEQ ID NO:401). An activating cleavage also is cleavage whereby a protein is cleaved into one or more proteins that themselves have activity. For example, the complement system is an irreversible cascade of proteolytic cleavage events whose termination results in the formation of multiple effector molecules that stimulate inflammation, facilitate antigen phagocytosis, and lyse some cells directly. Thus, cleavage of C3 by convertase into C3a and C3b is an activation cleavage.

As used herein, an inhibitory cleavage is cleavage of a protein into one or more degradation products that are not functional Inhibitory cleavage results in the diminishment or reduction of an activity of a protein. Typically, a reduction of an activity of a protein reduces the pathway or process for which the protein is involved. In one example, the cleavage of any one or more complement proteins that is an inhibitory cleavage results in the concomitant reduction or inhibition of any one or more of the classical, lectin, or alternative functional pathways of complement. To be inhibitory, the cleavage reduces activity by at least about 10%, 20%, 30%, 40%, 50%, 60%, 70%, 80%, 90%, 95%, 99.9% or more compared to a native form of the protein. The percent cleavage of a protein that is required for the cleavage to be inhibitory varies among proteins but can be determined by assaying for an activity of the protein.

As used herein, reference to a protease that cleaves VEGF or a VEGFR refers to a protease that is modified to cleave VEGF or a VEGFR or that in its native form cleaves VEGF or a VEGFR to thereby reduce or inactivate signaling of the VEGF or VEGFR complex, particularly cell proliferation signaling that can be manifested as a biological effect such as angiogenesis, particularly undesired angiogenesis. Cleavage of VEGF or VEGFR by a protease can be determined by assaying for the activity of a VEGF or VEGFR using any method or assay known to one of skill in the art to assess VEGF or VEGFR function.

As used herein, reference to a protease (modified or unmodified) that does not cleave VEGF or a VEGFR refers to a protease that does not reduce or inactivate signaling of the VEGF or a VEGFR complex. In particular, for purposes herein, the protease has greater substrate specificity or activity to a target substrate (i.e. a complement protein), such as or about 1-fold, 1.5-fold, 2-fold, 5-fold, 10-fold, 20-fold, 50-fold, 100-fold, 200-fold, 300-fold, 400-fold or more, than for a VEGF or a VEGFR protein or a peptide substrate that contains the corresponding cleavage sequence (i.e. RRVR (SEQ ID NO:713)). For purposes herein, comparison of cleavage of a complement protein with a VEGF or VEGFR protein or peptide substrate is under the same reaction conditions as a protease cleaves a complement protein.

As used herein, the "scaffold" or "protease scaffold" refers to a prototype protease that can be modified to alter its target specificity. Scaffolds include wildtype proteases, allelic variants and isoforms. They can serve as the starting material for modification to produce a protease that has a targeted specificity.

As used herein, a "modified protease," or "mutein protease" refers to a protease polypeptide (protein) that has one or more modifications in primary sequence compared to a scaffold protease. The one or more mutations can be one or more amino acid replacements (substitutions), insertions, deletions and any combination thereof. A modified protease polypeptide includes those with 1, 2, 3, 4, 5, 6, 7, 8, 9, 10, 11, 12, 13, 14, 15, 16, 17, 18, 19, 20, or more modified positions. A modified protease can be a full-length scaffold protease, or can be a catalytically active portion thereof of a modified full length scaffold protease as long as the modified protease contains modifications in regions that alter the activity or substrate specificity of the protease and the protease is proteolytically active. Generally, these mutations change the specificity and activity of the scaffold proteases for cleavage of any one or more of the complement proteins. In addition to containing modifications in regions that alter the substrate specificity of a protease, a modified protease also can tolerate other modifications in regions that are non-essential to the substrate specificity of a protease. Hence, a modified protease typically has 60%, 70%, 80%, 85%, 90%, 91%, 92%, 93%, 94%, 95%, 96%, 97%, 98%, 99% or more sequence identity to a corresponding sequence of amino acids of a wildtype or scaffold protease. A modified full-length protease or a catalytically active portion thereof of a modified protease can include proteases that are fusion proteins as long as the fusion itself does not alter substrate specificity of a protease.

As used herein, chymotrypsin numbering refers to the amino acid numbering of a mature chymotrypsin polypeptide of SEQ ID NO: 8. Alignment of a protease domain of another protease, such as for example the protease domain of MT-SP1, can be made with chymotrypsin. In such an instance, the amino acids of MT-SP1 that correspond to amino acids of chymotrypsin are given the numbering of the chymotrypsin amino acids. Corresponding positions can be determined by such alignment by one of skill in the art using manual alignments or by using the numerous alignment programs available (for example, BLASTP). Corresponding positions also can be based on structural alignments, for example by using computer simulated alignments of protein structure. Recitation that amino acids of a polypeptide correspond to amino acids in a disclosed sequence refers to amino acids identified upon alignment of the polypeptide with the disclosed sequence to maximize identity or homology (where conserved amino acids are aligned) using a standard alignment algorithm, such as the GAP algorithm. For example, upon alignment of the serine protease domain of MT-SP1 (SEQ ID NO: 10) with mature chymotrypsin, V at position 1 in MT-SP1 is given the chymotrypsin numbering of V16. Subsequent amino acids are numbered accordingly. In one example, an F at amino acid position 708 of full-length MT-SP1 (SEQ ID NO:2) or at position 94 of the protease domain of MT-SP1 (SEQ ID NO:10), corresponds to F99 based on chymotrypsin numbering. Where a residue exists in a protease, but is not present in chymotrypsin, the amino acid residue is given a letter notation. For example, residues in chymotrypsin that are part of a loop with amino acid 60 based on chymotrypsin numbering, but are inserted in the MT-SP1 sequence compared to chymotrypsin, are referred to for example as Asp60b or Arg60c.

As used herein, "inhibiting complement activation" or "complement inactivation" refers to the reduction or decrease of a complement-mediated function or activity of any one or more of the complement pathways by a protease or in the activity of any of the proteins in a pathway. A function or activity of complement can occur in vitro or in vivo. Exemplary functions of complement that can be assayed and that are described herein include hemolytic assays, and assays to measure any one or more of the complement effector molecules such as by SDS PAGE followed by Western Blot or Coomassie Brilliant Blue staining or by ELISA. A protease can inhibit complement activation by 5%, 10%, 20%, 30%, 40%, 50%, 60%, 70%, 80%, 90% or more. In other embodiments, complement activation is inhibited by a protease by 40%, 50%, 60%, 70%, 80%, 85%, 90%, 95% or 99.9% compared to the activity of complement in the absence of a protease.

As used herein, specificity for a target substrate refers to a preference for cleavage of a target substrate by a protease compared to another substrate, referred to as a non-target substrate. Specificity is reflected in the specificity constant ($k_{cat}/K_m$), which is a measure of the affinity of a protease for its substrate and the efficiency of the enzyme.

As used herein, a specificity constant for cleavage is ($k_{cat}/K_m$), wherein $K_m$ is the Michaelis-Menton constant ([S] at one half $V_{max}$) and $k_{cat}$ is the $V_{max}/[E_T]$, where $E_T$ is the final enzyme concentration. The parameters $k_{cat}$, $K_m$ and $k_{cat}/K_m$ can be calculated by graphing the inverse of the substrate concentration versus the inverse of the velocity of substrate cleavage, and fitting to the Lineweaver-Burk equation ($1/\text{velocity}=(K_m/V_{max})(1/[S])+1/V_{max}$; where $V_{max}[E_T]$ $k_{cat}$). Any method to determine the rate of increase of cleavage over time in the presence of various concentrations of substrate can be used to calculate the specificity constant. For example, a substrate is linked to a fluorogenic moiety, which is released upon cleavage by a protease. By determining the rate of cleavage at different enzyme concentrations, $k_{cat}$ can be determined for a particular protease. The specificity constant can be used to determine the site specific preferences of an amino acid in any one or more of the S1-S4 pockets of a protease for a concomitant P1-P4 amino acid in a substrate using standard methods in the art, such as a positional scanning combinatorial library (PS-SCL). Additionally, the specificity constant also can be used to determine the preference of a protease for one target substrate over another substrate.

As used herein, substrate specificity refers to the preference of a protease for one target substrate over another. Substrate specificity can be measured as a ratio of specificity constants.

As used herein, a substrate specificity ratio is the ratio of specificity constants and can be used to compare specificities of two or more proteases or a protease for two more substrates. For example, substrate specificity of a protease for competing substrates or of competing proteases for a substrate can be compared by comparing $k_{cat}/K_m$. For example, a protease that has a specificity constant of $2\times10^6$ $M^{-1}$ sec$^{-1}$ for a target substrate and $2\times10^4$ $M^{-1}$ sec$^{-1}$ for a non-target substrate is more specific for the target substrate. Using the specificity constants from above, the protease has a substrate specificity ratio of 100 for the target protease.

As used herein, preference or substrate specificity for a target substrate can be expressed as a substrate specificity ratio. The particular value of the ratio that reflects a preference is a function of the substrates and proteases at issue. A substrate specificity ratio that is greater than 1 signifies a preference for a target substrate and a substrate specificity less than 1 signifies a preference for a non-target substrate. Generally, a ratio of at least or about 1 reflects a sufficient difference for a protease to be considered a candidate therapeutic.

As used herein, altered specificity refers to a change in substrate specificity of a modified protease compared to a starting scaffold protease. Generally, the change in specificity is a reflection of the change in preference of a modified protease for a target substrate compared to a wildtype substrate of the scaffold protease (herein referred to as a non-target substrate). Typically, modified proteases provided herein exhibit increased substrate specificity for any one or more of the complement proteins compared to the substrate specificity of a scaffold protease. For example, a modified protease that has a substrate specificity ratio of 100 for a target substrate versus a non-target substrate exhibits a 10-fold increased specificity compared to a scaffold protease with a substrate specificity ratio of 10. In another example, a modified protease that has a substrate specificity ratio of 1 compared to a ratio of 0.1, exhibits a 10-fold increase in substrate specificity. To exhibit increased specificity compared to a scaffold protease, a modified protease has a 1.5-fold, 2-fold, 5-fold, 10-fold, 50-fold, 100-fold, 200-fold, 300-fold, 400-fold, 500-fold or more greater substrate specificity for any one of more of the complement proteins.

As used herein, "selectivity" can be used interchangeably with specificity when referring to the ability of a protease to choose and cleave one target substrate from among a mixture of competing substrates. Increased selectivity of a protease for a target substrate compared to any other one or more target substrates can be determined, for example, by comparing the specificity constants of cleavage of the target substrates by a protease. For example, if a protease has a specificity constant of cleavage of $2\times10^6$ $M^{-1}$ sec$^{-1}$ for a target substrate and $2\times10^4$ $M^{-1}$ sec$^{-1}$ for any other one of more substrates, the protease is more selective for the former target substrate.

As used herein, activity refers to a functional activity or activities of a polypeptide or portion thereof associated with a full-length (complete) protein. Functional activities include, but are not limited to, biological activity, catalytic or enzymatic activity, antigenicity (ability to bind to or compete with a polypeptide for binding to an anti-polypeptide antibody), immunogenicity, ability to form multimers, and the ability to specifically bind to a receptor or ligand for the polypeptide.

As used herein, a functional activity with reference to a complement protein refers to a complement-mediated function including, but not limited to, anaphylaxis, opsonization, chemotaxis, or cell lysis. Nonlimiting assays for testing activities of complement include hemolysis of red blood cells, and detection of complement effector molecules such as by ELISA or SDS-PAGE.

As used herein, catalytic activity or cleavage activity refers to the activity of a protease as assessed in in vitro proteolytic assays that detect proteolysis of a selected substrate. Cleavage activity can be measured by assessing catalytic efficiency of a protease.

As used herein, activity towards a target substrate refers to cleavage activity and/or functional activity, or other measurement that reflects the activity of a protease on or towards a target substrate. A functional activity of a complement protein target substrate by a protease can be measured by assessing an IC50 in a complement assay such as red blood cell lysis, or other such assays known by one of skill in the art or provided herein to assess complement activity. Cleavage activity can be measured by assessing catalytic efficiency of a protease. For purposes herein, an activity is increased if a protease exhibits greater proteolysis or cleavage of a target substrate and/or modulates (i.e. activates or inhibits) a functional activity of a complement protein as compared to in the absence of the protease.

As used herein, serine proteases or serine endopeptidases refers to a class of peptidases, which are characterized by the presence of a serine residue in the active center of the enzyme. Serine proteases participate in a wide range of functions in the body, including blood clotting and inflammation, as well as functioning as digestive enzymes in prokaryotes and eukaryotes. The mechanism of cleavage by serine proteases is based on nucleophilic attack of a targeted peptidic bond by a serine. Cysteine, threonine or water molecules associated with aspartate or metals also can play this role. Aligned side chains of serine, histidine and aspartate form a catalytic triad common to most serine proteases. The active site of serine proteases is shaped as a cleft where the polypeptide substrate binds.

As used herein, a complement protease refers to a protease that is involved in the generation and amplification of complement cascade reactions in any of the complement pathways. These proteases include the serine protease factor I, factor D, MBL-associated serine protease (MASP)-2, MASP-1, C1s, C1r, factor B, C2, and the convertases and any other protease that occurs in a complement pathway whereby complement activation is effected. In particular, complement proteases are any unmodified complement proteases, including factor I, factor D, MASP-2, MASP-1, C1s, C1r, factor B and C2.

As used herein, a non-complement protease is any protease that is not normally part of any one or more of the complement pathways.

As used herein, MT-SP1 refers to a serine protease that is part of the S1 peptidase family of serine proteases (also containing trypsin and chymotrypsin) based on the location of the Ser, His, and Lys active site residues. MT-SP1 is characterized by a transmembrane domain, two CUB domains, four LDLR repeats, and a serine protease domain (or peptidase S1 domain) that is highly conserved among all members of the peptidase S1 family of serine proteases, such as for example with chymotrypsin. The sequence of an exemplary MT-SP1 is set forth in SEQ ID NO: 2. The protease domain occurs between and includes amino acids 615-854.

Reference to an MT-SP1 protease includes a full-length MT-SP1 or any catalytically active portion thereof and includes allelic variants and species variants and variants encoded by splice variants. An MT-SP1 protease occurs as a single chain zymogen, and as an activated two-chain polypeptide. Reference to MT-SP1 includes active single-chain and two-chain forms thereof. Of particular interest are MT-SP1 proteases of mammalian, including human, origin. An MT-SP1 protease also can include those of rat or mouse origin. Those of skill in this art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. co., p. 224). Sequences of encoding nucleic molecules and the encoded amino acid sequences of exemplary MT-SP1 proteases of human origin and/or catalytically active domains thereof are set forth in SEQ ID NOS: 1, 2, 9 and 10. Exemplary MT-SP1 polypeptides of non-human origin are those having amino acid sequences such as in mice (*Mus musculus*, SEQ ID NO: 449) and rats (*Rattus norvegicus*, SEQ ID NO: 450). Herein, an MT-SP1 protease can be a scaffold MT-SP1.

As used herein, reference to a "catalytically active portion thereof" of an MT-SP1 protease refers to the protease domain, or any fragment or portion thereof that retains protease activity. For example, a catalytically active portion of an MT-SP1 can be an MT-SP1 protease domain including an isolated single chain form of the protease domain or an activated two-chain form.

As used herein, a modified MT-SP1 protease refers to a protease that exhibits altered activity, such as altered substrate specificity, compared to the scaffold or unmodified form. Such proteases include 1, 2, 3, 4, 5, 6, 7, 8, 9, 10, 11, 12, 13, 14, 15, 16, 17, 18, 19, 20, or more modifications (i.e. changes in amino acids) compared to a scaffold MT-SP1 such that an activity, such as substrate specificity or selectivity, of the MT-SP1 protease for cleaving a complement protein is altered. A modified MT-SP1 can be a full-length scaffold MT-SP1, or can be a portion thereof of a full length scaffold protease, as long as the modified protease contains modifications in regions that alter the activity or substrate specificity of the protease and the protease is proteolytically active. A modified MT-SP1 protease also can include other modifications in regions that do not impact on substrate specificity of the protease. Hence, a modified MT-SP1 protease typically has 60%, 70%, 80%, 85%, 90%, 91%, 92%, 93%, 94%, 95%, 96%, 97%, 98%, 99% or more sequence identity to a corresponding sequence of amino acids of a wildtype or scaffold MT-SP1. A modified full-length MT-SP1 protease or a catalytically active portion thereof of a modified MT-SP1 can include proteases that are fusion proteins as long as the fusion protein possesses the target specificity.

As used herein, a human protein is one encoded by a nucleic acid molecule, such as DNA, present in the genome of a human, including all allelic variants and conservative variations thereof. A variant or modification of a protein is a human protein if the modification is based on the wildtype or prominent sequence of a human protein.

As used herein, the residues of naturally occurring α-amino acids are the residues of those 20 α-amino acids found in nature which are incorporated into protein by the specific recognition of the charged tRNA molecule with its cognate mRNA codon in humans.

As used herein, non-naturally occurring amino acids refer to amino acids that are not genetically encoded.

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is from 2 to 40 amino acids in length.

As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, the "amino acids," which occur in the various amino acid sequences appearing herein, are identified according to their well-known, three-letter or one-letter abbreviations (see Table 1). The nucleotides, which occur in the various DNA fragments, are designated with the standard single-letter designations used routinely in the art.

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH$_2$ refers to the free amino group present at the amino terminus of a polypeptide. COOH refers to the free carboxy group present at the carboxyl terminus of a polypeptide. In keeping with standard polypeptide nomenclature described in *J. Biol. Chem.*, 243: 3557-3559 (1968), and adopted 37 C.F.R. §§1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |

TABLE 1-continued

Table of Correspondence

| SYMBOL | | |
|---|---|---|
| 1-Letter | 3-Letter | AMINO ACID |
| S | Ser | Serine |
| I | Ile | Isoleucine |
| L | Leu | Leucine |
| T | Thr | Threonine |
| V | Val | Valine |
| P | Pro | proline |
| K | Lys | Lysine |
| H | His | Histidine |
| Q | Gln | Glutamine |
| E | Glu | glutamic acid |
| Z | Glx | Glu and/or Gln |
| W | Trp | Tryptophan |
| R | Arg | Arginine |
| D | Asp | aspartic acid |
| N | Asn | asparagines |
| B | Asx | Asn and/or Asp |
| C | Cys | Cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as NH$_2$ or to a carboxyl-terminal group such as COOH.

As used herein, "naturally occurring amino acids" refer to the 20 L-amino acids that occur in polypeptides.

As used herein, "non-natural amino acid" refers to an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally-occurring amino acids and include, but are not limited to, the D-isostereomers of amino acids. Exemplary non-natural amino acids are described herein and are known to those of skill in the art.

As used herein, an isokinetic mixture is one in which the molar ratios of amino acids have been adjusted based on their reported reaction rates (see, e.g., Ostresh et al., (1994) Biopolymers 34:1681).

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term ortholog means a polypeptide or protein obtained from one species that is the functional counterpart of a polypeptide or protein from a different species. Sequence differences among orthologs are the result of speciation.

As used herein, the term polynucleotide means a single- or double-stranded polymer of deoxyribonucleotide or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule can not be paired. Such unpaired ends will, in general, not exceed 20 nucleotides in length.

As used herein, a protease polypeptide is a polypeptide having an amino acid sequence corresponding to any one of the scaffold or modified proteases described herein.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and Sequence Analysis Primer, Gribskov, M. and Devereux, J., eds., M Stockton Press, New York, 1991). While there exist a number of methods to measure identity between two polynucleotide or polypeptides, the term "identity" is well known to skilled artisans (Carrillo, H. & Lipman, D., *SIAM J Applied Math* 48:1073 (1988)).

As used herein, homologous (with respect to nucleic acid and/or amino acid sequences) means about greater than or equal to 25% sequence homology, typically greater than or equal to 25%, 40%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carrillo et al. (1988) *SIAM J Applied Math* 48:1073). By sequence homology, the number of conserved amino acids is determined by standard alignment algorithm programs, and can be used with default gap penalties established by each supplier. Substantially homologous nucleic acid molecules would hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J., et al., *Nucleic Acids Research* 12(I):387 (1984)), BLASTP, BLASTN, FASTA (Altschul, S. F., et al., *J Molec Biol* 215:403 (1990); Guide to Huge Computers, Martin J. Bishop, ed., Academic Press, San Diego, 1994, and Carrillo et al. (1988) *SIAM J Applied Math* 48:1073). For example, the BLAST function of the National Center for Biotechnology Information database can be used to determine identity. Other commercially or publicly available programs include the DNAStar "MegAlign" program (Madison, Wis.) and the University of Wisconsin Genetics Computer Group (UWG) "Gap" program (Madison Wis.)). Percent homology or identity of proteins and/or nucleic acid molecules can be determined, for example, by comparing sequence information using a GAP computer program (e.g., Needleman et al. (1970) *J. Mol. Biol.* 48:443, as revised by Smith and Waterman (1981) *Adv. Appl. Math.* 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., *ATLAS OF PROTEIN SEQUENCE AND STRUCTURE*, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term "at least 90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared, no more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers that includes a 5' (upstream) primer that hybridizes with the 5' end of a sequence to be amplified (e.g. by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species, have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include substitutions, deletions and insertions of nucleotides. An allele of a gene also can be a form of a gene containing a mutation.

As used herein, a splice variant refers to a variant produced by differential processing of a primary transcript of genomic DNA that results in more than one type of mRNA.

As used herein, modification is in reference to modification of a sequence of amino acids of a polypeptide or a sequence of nucleotides in a nucleic acid molecule and includes deletions, insertions, and replacements of amino acids and nucleotides, respectively.

For purposes herein, amino acid substitutions, deletions and/or insertions, can be made in any of the proteases and protease domains thereof provided that the resulting protein exhibits protease activity or other activity (or, if desired, such changes can be made to eliminate activity). Modifications can be made by making conservative amino acid substitutions and also non-conservative amino acid substitutions. For example, amino acid substitutions that desirably or advantageously alter properties of the proteins can be made. In one embodiment, mutations that prevent degradation of the polypeptide can be made. Many proteases cleave after basic residues, such as R and K; to eliminate such cleavage, the basic residue is replaced with a non-basic residue. Interaction of the protease with an inhibitor can be blocked while retaining catalytic activity by effecting a non-conservative change at the site of interaction of the inhibitor with the protease. Other activities also can be altered. For example, receptor binding can be altered without altering catalytic activity.

Amino acid substitutions contemplated include conservative substitutions, such as those set forth in Table 2, which do not eliminate proteolytic activity. As described herein, substitutions that alter properties of the proteins, such as removal of cleavage sites and other such sites also are contemplated; such substitutions are generally non-conservative, but can be readily effected by those of skill in the art.

Suitable conservative substitutions of amino acids are known to those of skill in this art and can be made generally without altering the biological activity, for example enzymatic activity, of the resulting molecule. Those of skill in this art recognize that, in general, single amino acid substitutions in non-essential regions of a polypeptide do not substantially alter biological activity (see, e.g., Watson et al. *Molecular Biology of the Gene,* 4th Edition, 1987, The Benjamin/Cummings Pub. co., p. 224). Also included within the definition, is the catalytically active fragment of a serine protease, particularly a single chain protease portion. Conservative amino acid substitutions are made, for example, in accordance with those set forth in TABLE 2 as follows:

TABLE 2

| Original residue | Conservative substitution |
| --- | --- |
| Ala (A) | Gly; Ser; Abu |
| Arg (R) | Lys; orn |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Ornithine | Lys; Arg |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu; Met |

Other substitutions also are permissible and can be determined empirically or in accord with known conservative substitutions.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term substantially free of cellular material includes preparations of proteins in which the protein is separated from cellular components of the cells from which it is isolated or recombinantly-produced. In one embodiment, the term substantially free of cellular material includes preparations of protease proteins having less that about 30% (by dry weight) of non-protease proteins (also referred to herein as a contaminating protein), generally less than about 20% of non-protease proteins or 10% of non-protease proteins or less that about 5% of non-protease proteins. When the protease protein or active portion thereof is recombinantly produced, it also is substantially free of culture medium, i.e., culture medium represents less than, about, or equal to 20%, 10% or 5% of the volume of the protease protein preparation.

As used herein, the term substantially free of chemical precursors or other chemicals includes preparations of protease proteins in which the protein is separated from chemical precursors or other chemicals that are involved in the synthesis of the protein. The term includes preparations of protease proteins having less than about 30% (by dry weight), 20%, 10%, 5% or less of chemical precursors or non-protease chemicals or components.

As used herein, production by recombinant means by using recombinant DNA methods refers to the use of the well known methods of molecular biology for expressing proteins encoded by cloned DNA.

As used herein, vector (or plasmid) refers to discrete elements that are used to introduce heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, an adenovirus refers to any of a group of DNA-containing viruses that cause conjunctivitis and upper respiratory tract infections in humans. As used herein, naked DNA refers to histone-free DNA that can be used for vaccines and gene therapy. Naked DNA is the genetic material that is passed from cell to cell during a gene transfer processed called transformation. In transformation, purified or naked DNA is taken up by the recipient cell which will give the recipient cell a new characteristic or phenotype.

As used herein, operably or operatively linked when referring to DNA segments means that the segments are arranged so that they function in concert for their intended purposes, e.g., transcription initiates in the promoter and proceeds through the coding segment to the terminator.

As used herein, protein binding sequence refers to a protein or peptide sequence that is capable of specific binding to other protein or peptide sequences generally, to a set of protein or peptide sequences or to a particular protein or peptide sequence.

As used herein, epitope tag refers to a short stretch of amino acid residues corresponding to an epitope to facilitate subsequent biochemical and immunological analysis of the epitope tagged protein or peptide. Epitope tagging is achieved by adding the sequence of the epitope tag to a protein-encoding sequence in an appropriate expression vector. Epitope tagged proteins can be affinity purified using highly specific antibodies raised against the tags.

As used herein, metal binding sequence refers to a protein or peptide sequence that is capable of specific binding to metal ions generally, to a set of metal ions or to a particular metal ion.

As used herein the term assessing is intended to include quantitative and qualitative determination in the sense of obtaining an absolute value for the activity of a protease, or a domain thereof, present in the sample, and also of obtaining an index, ratio, percentage, visual or other value indicative of the level of the activity. Assessment can be direct or indirect and the chemical species actually detected need not of course be the proteolysis product itself but can for example be a derivative thereof or some further substance. For example, detection of a cleavage product of a complement protein, such as by SDS-PAGE and protein staining with Coomassie blue.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a protease is its catalytic activity in which a polypeptide is hydrolyzed.

As used herein equivalent, when referring to two sequences of nucleic acids, means that the two sequences in question encode the same sequence of amino acids or equivalent proteins. When equivalent is used in referring to two proteins or peptides, it means that the two proteins or peptides have substantially the same amino acid sequence with only amino acid substitutions (such as, but not limited to, conservative changes such as those set forth in Table 2, above) that do not substantially alter the activity or function of the protein or peptide. When equivalent refers to a property, the property does not need to be present to the same extent (e.g., two peptides can exhibit different rates of the same type of enzymatic activity), but the activities are usually substantially the same. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, an agent that modulates the activity of a protein or expression of a gene or nucleic acid either decreases or increases or otherwise alters the activity of the protein or, in some manner, up- or down-regulates or otherwise alters expression of the nucleic acid in a cell.

As used herein, a "chimeric protein" or "fusion protein" protease refers to a polypeptide operatively-linked to a different polypeptide. A chimeric or fusion protein provided herein can include one or more proteases or a portion thereof, such as single chain protease domains thereof, and one or more other polypeptides for any one or more of a transcriptional/translational control signals, signal sequences, a tag for localization, a tag for purification, part of a domain of an immunoglobulin G, and/or a targeting agent. These chimeric or fusion proteins include those produced by recombinant means as fusion proteins, those produced by chemical means, such as by chemical coupling, through, for example, coupling to sulfhydryl groups, and those produced by any other method whereby at least one protease, or a portion thereof, is linked, directly or indirectly via linker(s) to another polypeptide.

As used herein, operatively-linked when referring to a fusion protein refers to a protease polypeptide and a non-protease polypeptide that are fused in-frame to one another. The non-protease polypeptide can be fused to the N-terminus or C-terminus of the protease polypeptide.

As used herein, a targeting agent, is any moiety, such as a protein or effective portion thereof, that provides specific binding of the conjugate to a cell surface receptor, which in some instances can internalize bound conjugates or portions thereof. A targeting agent also can be one that promotes or facilitates, for example, affinity isolation or purification of the conjugate; attachment of the conjugate to a surface; or detection of the conjugate or complexes containing the conjugate.

As used herein, an antibody conjugate refers to a conjugate in which the targeting agent is an antibody.

As used herein, derivative or analog of a molecule refers to a portion derived from or a modified version of the molecule.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are those involving complement activation, including those mediated by complement activation and those in which complement activation plays a role in the etiology or pathology. Diseases and disorders also include those that are caused by the absence of a protein such as an immune deficiency, and of interest herein are those disorders where complement activation does not occur due to a deficiency in a complement protein.

As used herein, a complement-mediated disorder is any disorder in which any one or more of the complement proteins plays a role in the disease, either due to an absence or presence of the protein. A complement-mediated disorder is one that is due to a deficiency in a complement protein. A complement-mediated disorder also is one that is due to the presence of any one or more of the complement proteins and the continued activation of the complement pathway.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of a modified protease and compositions provided herein.

As used herein, a therapeutic agent, therapeutic regimen, radioprotectant, or chemotherapeutic mean conventional drugs and drug therapies, including vaccines, which are known to those skilled in the art. Radiotherapeutic agents are well known in the art.

As used herein, treatment means any manner in which the symptoms of a condition, disorder or disease are ameliorated or otherwise beneficially altered. Treatment also encompasses any pharmaceutical use of the compositions herein.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing disease or condition is reduced.

As used herein an effective amount of a compound or composition for treating a particular disease is an amount that is sufficient to ameliorate, or in some manner reduce the symptoms associated with the disease. Such amount can be administered as a single dosage or can be administered according to a regimen, whereby it is effective. The amount can cure the disease but, typically, is administered in order to ameliorate the symptoms of the disease. Typically, repeated administration is required to achieve a desired amelioration of symptoms.

As used herein, "therapeutically effective amount" or "therapeutically effective dose" refers to an agent, compound, material, or composition containing a compound that is at least sufficient to produce a therapeutic effect. An effective amount is the quantity of a therapeutic agent necessary for preventing, curing, ameliorating, arresting or partially arresting a symptom of a disease or disorder.

As used herein, administration of a non-complement protease, such as a modified non-complement protease, refers to any method in which the non-complement protease is contacted with its substrate. Administration can be effected in vivo or ex vivo or in vitro. For example, for ex vivo administration a body fluid, such as blood, is removed from a subject and contacted outside the body with the modified non-complement protease. For in vivo administration, the modified non-complement protease can be introduced into the body, such as by local, topical, systemic and/or other route of introduction. In vitro administration encompasses methods, such as cell culture methods.

As used herein, an anticoagulant is a drug that helps prevent the clotting (coagulation) of blood. These drugs tend to prevent new clots from forming or an existing clot from enlarging.

As used herein, unit dose form refers to physically discrete units suitable for human and animal subjects and packaged individually as is known in the art.

As used herein, "patient" or "subject" to be treated includes humans and human or non-human animals. Mammals include primates, such as humans, chimpanzees, gorillas and monkeys; domesticated animals, such as dogs, horses, cats, pigs, goats, cows; and rodents such as mice, rats, hamsters and gerbils.

As used herein, a combination refers to any association between two or among more items. The association can be spacial or refer to the use of the two or more items for a common purpose.

As used herein, a composition refers to any mixture of two or more products or compounds (e.g., agents, modulators, regulators, etc.). It can be a solution, a suspension, liquid, powder, a paste, aqueous or non-aqueous formulations or any combination thereof.

As used herein, an "article of manufacture" is a product that is made and sold. As used throughout this application, the term is intended to encompass modified protease polypeptides and nucleic acids contained in articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, a "kit" refers to a packaged combination, optionally including reagents and other products and/or components for practicing methods using the elements of the combination. For example, kits containing a modified protease polypeptide or nucleic acid molecule provided herein and another item for a purpose including, but not limited to, administration, diagnosis, and assessment of a biological activity or property are provided. Kits optionally include instructions for use.

As used herein, a cellular extract refers to a preparation or fraction which is made from a lysed or disrupted cell.

As used herein, an agent is said to be randomly selected when the agent is chosen randomly without considering the specific sequences involved in the association of a protein alone or with its associated substrates, binding partners and/or other components. An example of randomly selected agents is the use of a chemical library or a peptide combinatorial library, or a growth broth of an organism or conditioned medium.

As used herein, a prodrug is a compound that, upon in vivo administration, is metabolized or otherwise converted to the biologically, pharmaceutically or therapeutically active form of the compound. To produce a prodrug, the pharmaceutically active compound is modified such that the active compound is regenerated by metabolic processes. The prodrug can be designed to alter the metabolic stability or the transport characteristics of a drug, to mask side effects or toxicity, to improve the flavor of a drug or to alter other characteristics or properties of a drug. By virtue of knowledge of pharmacodynamic processes and drug metabolism in vivo, those of skill in this art, once a pharmaceutically active compound is known, can design prodrugs of the compound (see, e.g., Nogrady (1985) *Medicinal Chemistry A Biochemical Approach*, Oxford University Press, New York, pages 388-392).

As used herein, a peptidomimetic is a compound that mimics the conformation and certain stereochemical features of a biologically active form of a particular peptide. In general, peptidomimetics are designed to mimic certain desirable properties of a compound, but not the undesirable properties, such as flexibility, that lead to a loss of a biologically active conformation and bond breakdown. Peptidomimetics can be prepared from biologically active compounds by replacing certain groups or bonds that contribute to the undesirable properties with bioisosteres. Bioisosteres are known to those of skill in the art. For example the methylene bioisostere CH2S has been used as an amide replacement in enkephalin analogs (see, e.g., Spatola (1983) pp. 267-357 in Chemistry and Biochemistry of Amino Acids, Peptides, and Proteins, Weinstein, Ed. volume 7, Marcel Dekker, New York). Morphine, which can be administered orally, is a compound that is a peptidomimetic of the peptide endorphin. For purposes herein, polypeptides in which one or more peptidic bonds that form the backbone of a polypeptide are replaced with bioisosteres are peptidomimetics.

As used herein, antibody includes antibody fragments, such as Fab fragments, which are composed of a light chain and the variable region of a heavy chain.

As used herein, a receptor refers to a molecule that has an affinity for a particular ligand. Receptors can be naturally-occurring or synthetic molecules. Receptors also can be referred to in the art as anti-ligands.

As used herein, primer refers to an oligonucleotide containing two or more deoxyribonucleotides or ribonucleotides, typically more than three, from which synthesis of a primer extension product can be initiated. Experimental conditions conducive to synthesis include the presence of nucleoside triphosphates and an agent for polymerization and extension, such as DNA polymerase, and a suitable buffer, temperature and pH.

As used herein, animal includes any animal, such as, but not limited to primates including humans, gorillas and monkeys; rodents, such as mice and rats; fowl, such as chickens; ruminants, such as goats, cows, deer, sheep; ovine, such as pigs and other animals. Non-human animals exclude humans as the contemplated animal. The proteases provided herein are from any source, animal, plant, prokaryotic and fungal. Most proteases are of animal origin, including mammalian origin.

As used herein, genetic therapy or gene therapy involves the transfer of heterologous nucleic acid, such as DNA, into certain cells, target cells, of a mammal, particularly a human, with a disorder or condition for which such therapy is sought. The nucleic acid, such as DNA, is introduced into the selected target cells, such as directly or in a vector or other delivery vehicle, in a manner such that the heterologous nucleic acid, such as DNA, is expressed and a therapeutic product encoded thereby is produced. Alternatively, the heterologous nucleic acid, such as DNA, can in some manner mediate expression of DNA that encodes the therapeutic product, or it can encode a product, such as a peptide or RNA that in some manner mediates, directly or indirectly, expression of a therapeutic product. Genetic therapy also can be used to deliver nucleic acid encoding a gene product that replaces a defective gene or supplements a gene product produced by the mammal or the cell in which it is introduced. The introduced nucleic acid can encode a therapeutic compound, such as a protease or modified protease, that is not normally produced in the mammalian host or that is not produced in therapeutically effective amounts or at a therapeutically useful time. The heterologous nucleic acid, such as DNA, encoding the therapeutic product can be modified prior to introduction into the cells of the afflicted host in order to enhance or otherwise alter the product or expression thereof. Genetic therapy also can involve delivery of an inhibitor or repressor or other modulator of gene expression.

As used herein, heterologous nucleic acid is nucleic acid that is not normally produced in vivo by the cell in which it is expressed or that is produced by the cell but is at a different locus or expressed differently or that mediates or encodes mediators that alter expression of endogenous nucleic acid, such as DNA, by affecting transcription, translation, or other regulatable biochemical processes. Heterologous nucleic acid is generally not endogenous to the cell into which it is introduced, but has been obtained from another cell or prepared synthetically. Heterologous nucleic acid can be endogenous, but is nucleic acid that is expressed from a different locus or altered in its expression. Generally, although not necessarily, such nucleic acid encodes RNA and proteins that are not normally produced by the cell or in the same way in the cell in which it is expressed. Heterologous nucleic acid, such as DNA, also can be referred to as foreign nucleic acid, such as DNA. Thus, heterologous nucleic acid or foreign nucleic acid includes a nucleic acid molecule not present in the exact orientation or position as the counterpart nucleic acid molecule, such as DNA, is found in a genome. It also can refer to a nucleic acid molecule from another organism or species (i.e., exogenous).

Any nucleic acid, such as DNA, that one of skill in the art would recognize or consider as heterologous or foreign to the cell in which the nucleic acid is expressed is herein encompassed by heterologous nucleic acid; heterologous nucleic acid includes exogenously added nucleic acid that also is expressed endogenously. Examples of heterologous nucleic acid include, but are not limited to, nucleic acid that encodes traceable marker proteins, such as a protein that confers drug resistance, nucleic acid that encodes therapeutically effective substances, such as anti-cancer agents, enzymes and hormones, and nucleic acid, such as DNA, that encodes other types of proteins, such as antibodies. Antibodies that are encoded by heterologous nucleic acid can be secreted or expressed on the surface of the cell in which the heterologous nucleic acid has been introduced.

As used herein, a therapeutically effective product for gene therapy is a product that is encoded by heterologous nucleic acid, typically DNA, that, upon introduction of the nucleic acid into a host, a product is expressed that ameliorates or eliminates the symptoms, manifestations of an inherited or acquired disease or that cures the disease. Also included are biologically active nucleic acid molecules, such as RNAi and antisense.

As used herein, a control refers to a sample that is substantially identical to the test sample, except that it is not treated with a test parameter, or, if it is a plasma sample, it can be from a normal volunteer not affected with the condition of interest. A control also can be an internal control.

As used herein, recitation that a polypeptide consists essentially of a recited sequence of amino acids means that only the recited portion, or a fragment thereof, of the full-length polypeptide is present. The polypeptide can optionally, and generally will, include additional amino acids from another source or can be inserted into another polypeptide. For example, for purposes herein, recitation that a polypeptide consists essentially of the protease domain means that the only portion of the polypeptide is a protease domain or a catalytically active portion thereof. The polypeptide can optionally, and generally will, include additional non-protease derived sequences of amino acids.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. TARGET: COMPLEMENT

The complement system and its components are the target substrates for modified proteases as provided herein. The proteases are modified or selected or identified to cleave one or more components of the system and to thereby provide a way to modulate the activity of the system. Such proteases can serve as therapeutics or as candidate therapeutics to modulate the activity of the complement system.

The complement system is part of the immune system and plays a role in the elimination of invading foreign organisms and initiates inflammatory responses. There are over 30 soluble and cell-membrane proteins that are part of the complement system. These proteins function not only in the antibody-mediated immune response, but also in the innate immune response to recognize and kill pathogens such as bacteria, virus-infected cells, and parasites. Complement proteins are produced constitutively by macrophages and hepatocytes, and are present in the circulation as inactive molecules. Several complement proteins are pro-enzyme proteases (termed zymogens) that are themselves activated by proteolytic cleavage to become effector proteases that cut peptide bonds in other complement proteins to activate them in turn. Since each activated protease can activate many substrate molecules, the initial activation is rapidly amplified to produce millions of effector molecules (a cascade). The complement system constitutes an irreversible cascade of proteolytic events whose termination results in the formation of multiple effector molecules that stimulate inflammation, facilitate antigen phagocytosis, and lyse some cells directly, and, thus, can serve as a therapeutic point of intervention for treatment of a variety of disorders that share a common pathology or include this system in the etiology or pathology.

There are three distinct pathways through which complement can be activated on the pathogen surface: the classical pathway, the alternative pathway, and the lectin pathway. These pathways are distinct in that the components required for their initiation are different, but the pathways ultimately generate the same set of effector molecules (see, e.g., FIG. 1). Likewise, the early events of each pathway are governed by a similar mechanism of triggered-enzyme cascades in which inactive complement zymogens are cleaved to yield two fragments, the larger of which is an active serine protease. The active protease is retained at the pathogen surface so that the subsequent complement zymogen is cleaved and activated to continue the proteolytic cascade of complement activation. The second fragment generated upon zymogen cleavage is a smaller peptide fragment which can act as a soluble mediator of complement functioning as an opsonin or proinflammatory mediator.

1. Nomenclature

The complement pathway contains over 30 soluble mediators (see Table 3), some of which are generated from the cleavage of inactive protein zymogens to yield two fragments. Table 3 depicts exemplary native complement proteins and provides a description of their polypeptide sequence, including the location in the polypeptide of encoded complement fragments thereof. For example, SEQ ID NO: 314 encodes a C5 complement protein and also encodes a C5a fragment of a complement protein, encoded by residues 678-751 of C5, that exhibits complement activity upon its generation following cleavage of C5 by a C5 convertase. The native components of complement are designated by a C followed by a number such as C1, C2, etc. . . . The numbering of the complement components is based on the order of their discovery rather than the order of the sequence of reactions within the complement cascade. As a result, the sequence of reactions of the complement cascades is C1, C4, C2, C3, C5, C6, C7, C8, and C9. Following activation, the products of the cleavage reactions are designated by adding lower case letters, the larger fragment generally being designated "b" and the smaller fragment as "a" (i.e. C4 is cleaved to generate C4b and C4a). In some instances C2a is designated as the larger cleavage product, although more generally C2b is considered the larger cleavage product. Consequently, the C3 convertase C3b2b is sometimes referred to as C3b2a. Inactive complement cleavage products are designated with an "i" (i.e. iC3b). The protein zymogen components specific to the alternative pathway of complement are not designated by a C, but are rather designated by different capital letters such as Factor B, which upon cleavage becomes Bb or Ba. The two initiating protease zymogens of the lectin pathway are designated as MASP-1 and MASP-2.

TABLE 3

Complement Proteins

| Entry Name | AC # | Gene Name | Amino acid length | Description | SEQ ID NO |
|---|---|---|---|---|---|
| C1QA_HUMAN | P02745 | C1QA | 245 | Complement C1q subcomponent, A chain precursor | 298 |
| C1QB_HUMAN | P02746 | C1QB | 251 | Complement C1q subcomponent, B chain precursor | 299 |
| C1QC_HUMAN | P02747 | C1QG, C1QC | 245 | Complement C1q subcomponent, C chain precursor | 300 |
| C1R_HUMAN | P00736 | C1R | 705 | Complement C1r subcomponent precursor (Complement component 1, r subcomponent) [Contains: Complement C1r subcomponent heavy chain (aa: 18-463); Complement C1r subcomponent light chain (aa: 464-705)] | 301; 302 |
| C1S_HUMAN | P09871 | C1S | 688 | Complement C1s subcomponent precursor (C1 esterase) [Contains: Complement C1s subcomponent heavy chain (aa: 16-437); Complement C1s subcomponent light chain (aa: 438-688)] | 303, 304 |
| C4BB_HUMAN | P20851 | C4BPB | 252 | C4b-binding protein beta chain precursor | 305 |
| C4BP_HUMAN | P04003 | C4BPA C4BP | 597 | C4b-binding protein alpha chain precursor (C4bp) (Proline-rich protein) (PRP) | 306 |
| CFAI_HUMAN | P05156 | IF | 583 | Complement factor I precursor (EC 3.4.21.45) (C3B/C4B inactivator) [Contains: Complement factor I heavy chain (aa: 19-335); Complement factor I light chain (340-583)] | 307, 308 |

TABLE 3-continued

Complement Proteins

| Entry Name | AC # | Gene Name | Amino acid length | Description | SEQ ID NO |
|---|---|---|---|---|---|
| CLUS_HUMAN | P10909 | CLU | 449 | Clusterin precursor (Complement-associated protein SP-40, 40) (Complement cytolysis inhibitor) (CLI) (NA1/NA2) (Apolipoprotein J) (Apo-J) (Testosterone-repressed prostate message 2) (TRPM-2) [Contains: Clusterin beta chain (ApoJalpha) (Complement cytolysis inhibitor a chain) (aa: 23-227); Clusterin alpha chain (ApoJbeta) (Complement cytolysis inhibitor b chain) (aa: 228-449)] | 309 |
| CO2_HUMAN | P06681 | C2 | 752 | Complement C2 precursor (EC 3.4.21.43) (C3/C5 convertase) | 310, 311 |
| CO3_HUMAN | P01024 | C3 | 1663 | Complement C3 precursor [Contains: Complement C3 beta chain (aa: 23-667); Complement C3 alpha chain (aa: 672-1663); C3a anaphylatoxin (aa: 672-748); Complement C3b alpha' chain (aa: 749-1663); Complement C3c fragment (aa: 749-954); Complement C3dg fragment (aa: 955-1303); Complement C3g fragment (aa: 955-1001); Complement C3d fragment (aa: 1002-1303); C3f fragment (aa: 1304-1320)] | 312 |
| CO4_HUMAN | P01028 | C4A and C4B | 1744 | Complement C4 precursor [Contains: Complement C4 beta chain (aa: 20-675); Complement C4 alpha chain (aa: 680-1446); C4a anaphylatoxin (680-756); C4b (aa: 757-1446); Complement C4 gamma chain (aa: 1454-1744)] | 313 |
| CO5_HUMAN | P01031 | C5 | 1676 | Complement C5 precursor [Contains: Complement C5 beta chain (aa: 19-673); Complement C5 alpha chain (aa: 678-1676); C5a anaphylatoxin (aa: 678-751); Complement C5 alpha' chain (aa: 752-1676)] | 314 |
| CO6_HUMAN | P13671 | C6 | 934 | Complement component C6 precursor | 315 |
| CO7_HUMAN | P10643 | C7 | 843 | Complement component C7 precursor | 316 |
| CO8A_HUMAN | P07357 | C8A | 584 | Complement component C8 alpha chain precursor (Complement component 8 alpha subunit) | 317 |
| CO8B_HUMAN | P07358 | C8B | 591 | Complement component C8 beta chain precursor (Complement component 8 beta subunit) | 318 |
| CO8G_HUMAN | P07360 | C8G | 202 | Complement component C8 gamma chain precursor | 319 |
| CO9_HUMAN | P02748 | C9 | 559 | Complement component C9 precursor [Contains: Complement component C9a (aa: 22-265); Complement component C9b (aa: 266-559)] | 320 |
| CR1_HUMAN | P17927 | CR1, C3BR | 2039 | Complement receptor type 1 precursor (C3b/C4b receptor) (CD35 antigen) | 321 |
| CR2_HUMAN | P20023 | CR2, C3DR | 1033 | Complement receptor type 2 precursor (Cr2) (Complement C3d receptor) (Epstein-Barr virus receptor) (EBV receptor) (CD21 antigen) | 322 |
| DAF_HUMAN | P08174 | DAF, CD55, CR | 381 | Complement decay-accelerating factor precursor (CD55 antigen) | 323 |
| IC1_HUMAN | P05155 | SERPING1, C1IN, C1NH | 500 | Plasma protease C1 inhibitor precursor (C1 Inh) (C1Inh) | 324 |
| MASP1_HUMAN | P48740 | MASP1, CRARF, CRARF1, PRSS5 | 699 | Complement-activating component of Ra-reactive factor precursor (EC 3.4.21.—) (Ra-reactive factor serine protease p100) (RaRF) (Mannan-binding lectin serine protease 1) (Mannose-binding protein associated serine protease) (MASP-1) [Contains: Complement-activating component of Ra-reactive factor heavy chain (aa: 20-448); Complement-activating component of Ra-reactive factor light chain (aa: 449-699)] | 325, 326 (V1); 327, 328 (V2); 329, 330 (V3) |
| MASP2_HUMAN | O00187 | MASP2 | 686 | Mannan-binding lectin serine protease 2 precursor (EC 3.4.21.—) (Mannose-binding protein associated serine protease 2) (MASP-2) (MBL-associated serine protease 2) [Contains: Mannan-binding lectin serine protease 2 A chain (aa: 16-444); Mannan-binding lectin serine protease 2 B chain (aa: 445-686)] | 331, 332 (V1); 333, 334 (V2) |
| MBL2_HUMAN | P11226 | MBL2, MBL | 248 | Mannose-binding protein C precursor (MBP-C) (MBP1) (Mannan-binding protein) (Mannose-binding lectin) | 335 |
| MCP_HUMAN | P15529 | MCP | 392 | Membrane cofactor protein precursor (CD46 antigen) (Trophoblast leukocyte common antigen) (TLX) | 336 |
| CFAB_HUMAN | P00751 | BF | 764 | Complement factor B precursor (C3/C5 convertase) (Properdin factor B) (Glycine-rich beta glycoprotein) (GBG) (PBF2) [Contains: Complement factor B Ba fragment (aa: 26-259); Complement factor B Bb fragment (aa: 260-764)] | 337, 338 |
| CFAD_HUMAN | P00746 | DF | 253 | Complement factor D precursor (C3 convertase activator) (Properdin factor D) (Adipsin) | 339, 340 |
| CFAH_HUMAN | P08603 | CFH, HF, HF1 | 1231 | Complement factor H precursor (H factor 1) | 341, 342 |

TABLE 3-continued

Complement Proteins

| Entry Name | AC # | Gene Name | Amino acid length | Description | SEQ ID NO |
|---|---|---|---|---|---|
| PROP_HUMAN | P27918 | PFC | 469 | Properdin precursor (Factor P) | 343, 344 |
| FCN2_HUMAN | Q15485 | FCN2 | 313 | Ficolin-2 (collagen/fibrinogen domain-containing protein 2; ficolin B; serum lectin p35; L-Ficolin | 660 |
| FCN1_HUMAN | O00602 | FCN1 | 326 | Ficolin-1 (collagen/fibrinogen domain-containing protein 1; Ficolin A; M-Ficolin) | 661 |
| FCN3_HUMAN | O75636 | FCN3 | 299 | Ficolin-3 (collagen/fibrinogen domain-contain 3; collagen/fibrinogen domain-containing lectin 3 p35; Hakata antigen; Factor-H) | 662 |

2. Pathways of Complement Initiation

The pathways of complement are distinct in that they rely on different molecules and mechanisms for their initiation, but the pathways are similar in that they converge to generate the same set of effector molecules. The convergence point of the C pathways is the cleavage of C3 by C3 convertase (a C3 activating enzyme). Convertase is a general name used for a complement enzyme that converts an inactive complement protein into an active one. For example, C3 convertase converts inactive C3 to active C3a and C3b. Different enzyme complexes have C3 convertase activity. For example, in the classical pathway C4b2b acts as a C3 convertase, whereas in the alternative pathway, C3bBb is a C3 convertase (see Table 4). Cleavage of C3 generates C3b, which acts as an opsonin and as the main effector molecule of the complement system for subsequent complement reactions, and C3a, which is a peptide mediator of inflammation. The addition of C3b to each C3 convertase forms a C5 convertase to generate C5a and C5b. C5a, like C3a, is a peptide mediator of inflammation. C5b mediates the "late" events of complement activation initiating the sequence of reactions culminating in the generation of the membrane attack complex (MAC). Although the three pathways produce different C3 and C5 convertases, all of the pathways produce the split products of C3 and C5 and form MAC.

TABLE 4

Complement Cascades

| Activators | Alternative Pathway Pathogen surface molecules LPS, teichoic acid, zymosan | Classical Pathway antigen-bound IgM and IgG; non-immune molecules | Lectin Pathway Pathogens via recognition of carbohydrates on surface |
|---|---|---|---|
| C3 convertase | C3bBb | C4b2b | C4b2b |
| C5 convertase | C3bBb3b | C4b2b3b | C4b2b3b |
| MAC | C5678poly9 | C5678poly9 | C5678poly9 |
| anaphylatoxins | C3a, C5a | C3a, C4a, C5a | C3a, C4a, C5a | a. Classical Pathway

C1q is the first component of the classical pathway of complement. C1q is a calcium-dependent binding protein associated with the collectin family of proteins due to an overall shared structural homology (Malhotra R et al., Clin Exp Immunol. 1994, 97(2):4-9; Holmskov et al. Immunol Today. 1994, 15(2):67-74). Mannose binding lectin (MBL), the first component of the lectin pathway, also is a member of the collectin family. Collectins are named because they contain a collagen-like and lectin domain. The amino-terminal collagen-like region of the collectin structure interacts with cell surface receptors and confers structural stability to the protein. The carboxy-terminal regions of the collectin structure have a calcium-dependent lectin activity. The lectin domain mediates the interaction of the collectins with a wide variety of pathogens due to the recognition of carbohydrate moieties on the surface of pathogens. Collectins, often called pattern recognition molecules, generally function as opsonins to target pathogens for phagocytosis by immune cells. In contrast to conventional collectins, such as MBL, the carboxy-terminal globular recognition domain of C1q does not have lectin activity but can serve as a "charged" pattern recognition molecule due to marked differences in the electrostatic surface potential of its globular domains (Gaboriaud et al. J. Biol. Chem., 2003, 278(47): 46974-46982).

C1q initiates the classical pathway of complement in two different ways. First, the classical pathway is activated by the interaction of C1q with immune complexes (i.e. antigen-antibody complexes or aggregated IgG or IgM antibody) thus linking the antibody-mediated humoral immune response with complement activation. When the Fab portion (the variable region) of IgM or IgG binds antigen, the conformation of the Fc (constant) region is altered, allowing C1q to bind. C1q must bind at least 2 Fc regions to be activated, so it takes two IgG molecules to activate C1q. Serum IgM is a pentamer of five IgM molecules with five Fc regions, so IgM activates complement most efficiently. IgA, IgE and IgD do not bind C1q and cannot activate complement. C1q, however, also is able to activate complement in the absence of antibody thereby functioning in the innate or immediate immune response to infection. Besides antibody, complement activation also is achieved by the interaction of C1q with non-immune molecules such as polyanions (bacterial lipopolysaccharides, DNA, and RNA), certain small polysaccharides, viral membranes, C reactive protein (CRP), serum amyloid P component (SAP), and bacterial, fungal and virus membrane components.

C1q is part of the C1 complex which contains a single C1q molecule bound to two molecules each of the zymogens C1r and C1s. Binding of more than one of the C1q globular domains to a target surface (such as aggregated antibody or a pathogen), causes a conformational change in the (C1r:C1s)₂ complex which results in the activation of the C1r protease to cleave C1s to generate an active serine protease. Active C1s cleaves subsequent complement components C4 and C2 to generate C4b and C2b, which together form the C3 convertase of the classical pathway. The C3 convertase cleaves C3 into C3b, which covalently attaches to the pathogen surface and acts as an opsonin, and C3a, which stimulates inflammation. Some C3b molecules associate with C4b2b complexes yielding C4b2b3b which is the classical cascade C5 convertase. Table 5 summarizes the proteins involved in the classical pathway of complement.

TABLE 5

Proteins of the Classical Pathway

| Native Component | Active Form | Function of the Active Form |
|---|---|---|
| C1 (C1q:(C1r:C1s)$_2$) | C1q | Binds directly to pathogen surfaces or indirectly to antibody bound to pathogens |
| | C1r | Cleaves C1s to an active protease |
| | C1s | Cleaves C4 and C2 |
| C4 | C4b | Binds to pathogen and acts as an opsonin; binds C2 for cleavage by C1s |
| | C4a | Peptide mediator of inflammation |
| C2 | C2b | Active enzyme of classical pathway C3/C5 convertase; cleaves C3 and C5 |
| | C2a | Precursor of vasoactive C2 kinin |
| C3 | C3b | Binds to pathogen surfaces and acts as an opsonin; initiates amplification via the alternative pathway; binds C5 for cleavage by C2b |
| | C3a | Peptide mediator of inflammation | b. Alternative Pathway

The alternative pathway is initiated by foreign pathogens in the absence of antibody. Instead, the initiation of complement by the alternative pathway occurs through the spontaneous hydrolysis of C3 into C3b. A small amount of C3b is always present in body fluids, due to serum and tissue protease activity. Host self-cells normally contain high levels of membrane silica acid which inactivate C3b if it binds, but bacteria contain low external sialic acid and thereby bind C3b without inactivating it. C3b on pathogen surfaces is recognized by the protease zymogen Factor B. Factor B is cleaved by Factor D. Factor D is the only activating protease of the C system that circulates as an active enzyme rather than as a zymogen, but since Factor B is the only substrate for Factor D the presence of low levels of an active protease in normal serum is generally safe for the host. Cleavage of Factor B by Factor D yields the active product Bb which can associate with C3b to form C3bBb, the C3 convertase of the alternative pathway. Similar to the classical pathway, the C3 convertase produces more C3b and C3a from C3. C3b covalently attaches to the pathogen surface and acts as an opsonin, while C3a stimulates inflammation. Some C3b joins the complex to form C3bBb3b, the alternative pathway C5 convertase. C3bBb3b is stabilized by the plasma protein properdin or Factor P which binds to microbial surfaces and stabilizes the convertase. Table 6 summarizes the proteins involved in the alternative pathway of complement.

TABLE 6

Proteins of the Alternative Pathway

| Native Component | Active Form | Function of the Active Form |
|---|---|---|
| C3 | C3b | Binds to pathogen surface, binds Factor B for cleavage by Factor D |
| Factor B | Ba | Small fragment of Factor B, unknown function |
| | Bb | Active enzyme of the C3 convertase and C5 convertase |
| Factor D | D | Plasma serine protease, cleaves Factor B when it is bound to C3b to Ba and Bb |
| Factor P (properdin) | P | Plasma proteins with affinity for C3bBb convertase on bacterial cells; stabilizes convertase | c. Lectin

The lectin pathway (also referred to as the MBL pathway) is initiated following recognition and binding of pathogen-associated molecular patterns (PAMPs; i.e. carbohydrates moieties) by lectin proteins. Examples of lectin proteins that activate the lectin pathway of complement include mannose binding lectin (MBL) and ficolins (i.e. L-ficolin, M-ficolin, and H-ficolin). As mentioned above, MBL is a member of the collectin family of proteins and thereby exists as an oligomer of subunits composed of identical polypeptide chains each of which contains a cysteine-rich, a collagen-like, a neck, and a carbohydrate-recognition or lectin domain. MBL acts as a pattern recognition molecule to recognize carbohydrate moieties, particularly neutral sugars such as mannose or N-acetylglucosamine (GlcNAc) on the surface of pathogens via its globular lectin domain in a calcium-dependent manner. Besides a role in the complement system, MBL also acts as an opsonin to facilitate the phagocytosis of bacterial, viral, and fungal pathogens by phagocytic cells. In addition, other initiators of the lectin pathway include the ficolins including L-ficolin, M-ficolin, and H-ficolin (see e.g., Liu et al. (2005) J. Immunol., 175:3150-6). Similar to MBL, ficolins recognize carbohydrate moieties such as, for example, N-acetyl glucosamine and mannose structures.

The activation of the alternative pathway by MBL or ficolins is analogous to activation of the classical pathway by C1q whereby a single lectin molecule interacts with two protease zymogens. In the case of the lectin proteins, the zymogens are MBL-associated serine proteases, MASP-1 and MASP-2, which are closely homologous to the C1r and C1s zymogens of the classical pathway. Upon recognition of a PAMP by a lectin protein, such as for example by binding to a pathogen surface, MASP-1 and MASP-2 are activated to cleave C4 and C2 to form the MBL cascade C3 convertase. C3b then joins the complex to form the MBL cascade C5 convertase. MASP activation is implicated not only in responses to microorganisms, but in any response that involves exposing neutral sugars, including but not limited to tissue injury, such as that observed in organ transplants. Like the alternative cascade, the MBL cascade is activated independent of antibody; like the classical cascade, the MBL cascade utilizes C4 and C2 to form C3 convertase. Table 7 summarizes the proteins involved in the lectin pathway of complement.

TABLE 7

Proteins of the Lectin Pathway

| Native Component | Active Form | Function of the Active Form |
|---|---|---|
| MBL | MBL | Recognizes PAMPs, such as on pathogen surfaces (e.g., via recognition of carbohydrates) |
| Ficolins | L-Ficolin; M-Ficolin, or H-Ficolin | Recognizes PAMPs, such as on pathogen surfaces (e.g., via recognition of carbohydrates) |
| MASP-1 | MASP-1 | Cleaves C4 and C2 |
| MASP-2 | MASP-2 | Cleaves C4 and C2 |

3. Complement-Mediated Effector Functions

Regardless of which initiation pathway is used, the end result is the formation of activated fragments of complement proteins (e.g. C3a, C4a, and C5a anaphylatoxins and C5b-9 membrane attack complexes). These fragments mediate several functions including leukocyte chemotaxis, activation of macrophages, vascular permeability and cellular lysis (Frank, M. and Fries, L. Complement. In Paul, W. (ed.) Fundamental Immunology, Raven Press, 1989). A summary of some effector functions of complement products are listed in Table 8.

TABLE 8

Complement Effector Molecules and Functions

| Product | Activity |
|---|---|
| C2b (prokinin) | accumulation of body fluid |
| C3a (anaphylatoxin) | basophil and mast cell degranulation; enhanced vascular permeability; smooth muscle contraction; Induction of suppressor T cells |
| C3b and its products | opsonization; Phagocyte activation |
| C4a (anaphylatoxin) | basophil & mast cell activation; smooth muscle contraction; enhanced vascular permeability |
| C4b | opsonization |
| C5a (anaphylatoxin; chemotactic factor) | basophil & mast cell activation; enhanced vascular permeability; smooth muscle contraction; chemotaxis; neutrophil aggregation; oxidative metabolism stimulation; stimulation of leukotriene release; induction of helper T-cells |
| C5b67 | chemotaxis; attachment to other cell membranes and lysis of bystander cells |
| C5b6789 (C5b-9) | lysis of target cells | a. Complement-Mediated Lysis: Membrane Attack Complex

The final step of the complement cascade by all three pathways is the formation of the membrane attack complex (MAC) (FIG. 1). C5 can be cleaved by any C5 convertase into C5a and C5b. C5b combines with C6 and C7 in solution, and the C5b67 complex associates with the pathogen lipid membrane via hydrophobic sites on C7. C8 and several molecules of C9, which also have hydrophobic sites, join to form the membrane attack complex, also called C5b6789 or C5b-9. C5b-9 forms a pore in the membrane through which water and solutes can pass, resulting in osmotic lysis and cell death. If complement is activated on an antigen without a lipid membrane to which the C5b67 can attach, the C5b67 complex can bind to nearby cells and initiate bystander lysis. A single MAC can lyse an erythrocyte, but nucleated cells can endocytose MAC and repair the damage unless multiple MACs are present. Gram negative bacteria, with their exposed outer membrane and enveloped viruses, are generally susceptible to complement-mediated lysis. Less susceptible are Gram positive bacteria, whose plasma membrane is protected by their thick peptidoglycan layer, bacteria with a capsule or slime layer around their cell wall, or viruses which have no lipid envelope. Likewise, the MAC can be disrupted by proteins that bind to the complex before membrane insertion such as Streptococcal inhibitor of complement (SIC) and clusterin. Typically, the MAC helps to destroy gram-negative bacteria as well as human cells displaying foreign antigens (virus-infected cells, tumor cells, etc.) by causing their lysis and also can damage the envelope of enveloped viruses.

b. Inflammation

Inflammation is a process in which blood vessels dilate and become more permeable, thus enabling body defense cells and defense chemicals to leave the blood and enter the tissues. Complement activation results in the formation of several proinflammatory mediators such as C3a, C4a, and C5a. The intact anaphylatoxins in serum or plasma are quickly converted into the more stable, less active C3a-desArg, C4a-desArg, or C5a-desArg forms, by carboxypeptidase N. C3a, C4a and C5a, and to a lesser extent their desArg derivatives, are potent bioactive polypeptides, termed anaphylatoxins because of their inflammatory activity. Anaphylatoxins bind to receptors on various cell types to stimulate smooth muscle contraction, increase vascular permeability, and activate mast cells to release inflammatory mediators. Among the three anaphylatoxins, C5a is the most potent. C5a primarily acts on white blood cells, and in particular neutrophils. C5a stimulates leukocyte adherence to blood vessel walls at the site of infection by stimulating the increased expression of adhesion molecules so that leukocytes can squeeze out of the blood vessels and into the tissues, a process termed diapedesis. C5a also stimulates neutrophils to produce reactive oxygen species for extracellular killing, proteolytic enzymes, and leukotrienes. C5a also can further amplify the inflammatory process indirectly by inducing the production of chemokines, cytokines, and other proinflammatory mediators. C5a also interacts with mast cells to release vasodilators such as histamine so that blood vessels become more permeable. C3a also interacts with white blood cells, with major effects on eosinophils suggesting a role for C3a in allergic inflammation. C3a induces smooth muscle contraction, enhances vascular permeability, and causes degranulation of basophils and release of histamine and other vasoactive substances. C2a can be converted to C2 kinin, which regulates blood pressure by causing blood vessels to dilate.

Although technically not considered an anaphylatoxin, iC3b, an inactive derivative of C3b, functions to induce leukocyte adhesion to the vascular endothelium and induce the production of the pro-inflammatory cytokine IL-1 via binding to its cell surface integrin receptors. C5b-9 also indirectly stimulates leukocyte adhesion, activation, and chemotaxis by inducing the expression of cell adhesion molecules such as E-selectin, and inducing interleukin-8 secretion (Bhole et al. (2003) Crit. Care Med 31(1): 97-104). C5b-9 also stimulates the release of secondary mediators that contribute to inflammation, such as for example prostaglandin $E_2$, leukotriene $B_4$, and thromboxane.

Conversion of the human complement components C3 and C5 to yield their respective anaphylatoxin products has been implicated in certain naturally occurring pathologic states including: autoimmune disorders such as systemic lupus erythematosus, rheumatoid arthritis, malignancy, myocardial infarction, Purtscher's retinopathy, sepsis and adult respiratory distress syndrome. In addition, increased circulating levels of C3a and C5a have been detected in certain conditions associated with iatrogenic complement activation such as: cardiopulmonary bypass surgery, renal dialysis, and nylon fiber leukaphoresis. Elevated levels of C4a anaphylatoxin is associated with the autoimmune disorders mentioned above.

c. Chemotaxis

Chemotaxis is a process by which cells are directed to migrate in response to chemicals in their environment. In the immune response, a variety of chemokines direct the movement of cells, such as phagocytic cells, to sites of infection. For example, C5a is the main chemotactic factor for circulating neutrophils, but also can induce chemotaxis of monocytes. Phagocytes will move towards increasing concentrations of C5a and subsequently attach, via their CR1 receptors, to the C3b molecules attached to the antigen. The chemotactic effect of C5a, observed with basophils, eosinophils, neutrophils, and mononuclear phagocytes, is active at concentrations as low as $10^{-10}$M.

d. Opsonization

An important action of complement is to facilitate the uptake and destruction of pathogens by phagocytic cells. This occurs by a process termed opsonization whereby complement components bound to target bacteria interact with complement receptors on the surface of phagocytic cells such as neutrophils or macrophages. In this instance, the complement effector molecules are termed opsonins Opsonization of pathogens is a major function of C3b and C4b. iC3b also functions as an opsonin. C3a and C5a increase the expression of C3b receptors on phagocytes and increase their metabolic activity.

C3b and, to a lesser extent, C4b help to remove harmful immune complexes from the body. The C3b and C4b attach the immune complexes to CR1 receptors on erythrocytes. The erythrocytes then deliver the complexes to fixed macrophages within the spleen and liver for destruction. Immune complexes can lead to a harmful Type III hypersensitivity e. Activation of the Humoral Immune Response Activation of B cells requires ligation of the B cell receptor (BCR) by antigen. It has been shown, however, that complement plays a role in lowering the threshold for B cell responses to antigen by up to 1000-fold. This occurs by the binding of C3d or C3dg, complement products generated from the breakdown fragments of C3, to CR2 receptors on B-lymphocytes which can co-ligate with the BCR. Co-ligation occurs when antigenic particles, such as for example immune complexes, opsonized with C3d binds the CR2 receptor via C3d as well as the BCR through antigen. Co-ligation of antigen complexes also can occur when C3d binds to antigens enhancing their uptake by antigen presenting cells, such as dendritic cells, which can then present the antigen to B cells to enhance the antibody response. Mice deficient in CR2 display defects in B cell function that result in reduced levels of natural antibody and impaired humoral immune responses.

4. Complement Receptors

The recognition of complement effector molecules by cells for the initiation of effector functions such as chemotaxis and opsonization is mediated by a diverse group of complement receptors. The complement receptors are distributed on a wide range of cell types including erythrocytes, macrophages, B cells, neutrophils, and mast cells. Upon binding of a complement component to the receptor, the receptors initiate an intracellular signaling cascade resulting in cell responses such as stimulating phagocytosis of bacteria and secreting inflammatory molecules from the cell. For example, the complement receptors CR1 and CR2 which recognize C3b, C4b, and their products are important for stimulating chemotaxis. CR3 (CD11b/CD18) and CR4 (CD11c/CD18) are integrins that are similarly important in phagocytic responses but also play a role in leukocyte adhesion and migration in response to iC3b. The C5a and C3a receptors are G protein-coupled receptors that play a role in many of the pro-inflammatory-mediated functions of the C5a and C3a anaphylatoxins. For example, receptors for C3a, C3aR, exist on mast cells, eosinophils, neutrophils, basophils and monocytes and are directly involved in the pro-inflammatory effects of C3a.

5. Complement Regulation

Although the complement system is beneficial to the host by protecting against foreign pathogens, the production of inflammatory mediators can be toxic and damaging leading to a wide variety of inflammatory disease conditions as discussed below. Likewise, although most of the active proteases of the complement system are zymogens that only become activated locally upon cleavage, nearly all components of complement are spontaneously activated at low rates in serum and thus their activity needs to be minimized. Consequently, regulatory proteins of the complement system have been identified. Their primary functions are to regulate the activity of complement activating molecules for prevention of excessive complement activation and autolytic destruction of host tissues. These complement regulators are either soluble plasma proteins or integral membrane proteins expressed on a variety of cell types. The former include C4b binding protein (C4 bp) and Factor H. The latter include the C3b/C4b receptor (Complement receptor 1, CR1, CD35), membrane cofactor protein (MCP, CD46), and decay accelerating factor (DAF, CD55). These proteins possess many structural similarities. Each is composed of multiple short consensus repeats (SCRs) of approximately 60 amino acids in length having conserved cysteine, glycine and proline residues. The genes encoding these proteins have been localized to chromosome 1 and are collectively known as the regulators of complement activation (RCA) gene cluster (Hourcade et al. (1989) Adv. Immunol. 45:381).

C1 inhibitor (C1INH) is a serine proteinase inhibitor or serpin which dissociates activated C1r and C1s from C1q, limiting the time the complex is active. C1INH also blocks spontaneous activation of C1 by plasma proteases. Deficiency in C1INH is associated with serious sudden edema (swelling) called Angioneurotic Edema. Several inhibitory proteins dissociate the C3 and C5 convertases and promote degradation of C4b and C3b by Factor I, a plasma protease. Factor I circulates in an active form but it is only able to cleave C3b and C4b when they are bound to a cofactor protein. Factor I cleaves C3b leading to the production of iC3b, C3c, C3d, C3f, and C3dg thereby permanently inactivating C3b, although the degradation products can act as effector molecules, since, for example, iC3b acts as an opsonin. C4b is inactivated upon cleavage into C4c and C4d. The inhibitory proteins that serve as cofactors for Factor I include plasma proteins C4 binding protein that dissociates classical C3 convertase, and Factor H that dissociates alternative C3 convertase, and membrane proteins Complement Receptor 1 (CR1), Decay Accelerating Factor (DAF), and Membrane Cofactor Protein (MCP) that inhibit the activity of both pathways. Cofactors for Factor I regulate its activity. For example, human cells produce Factor H that binds to C3b and allows Factor I to inactivate C3b. On the other hand, substances such as LPS on bacterial cells, which otherwise do not express Factor I cofactors, facilitate the binding of Factor B to C3b and this protects the C3b from inactivation by Factor I.

Other membrane and plasma proteins block the formation of MAC on host cells to prevent the inappropriate insertion of MAC into membranes. Several plasma proteins, such as the soluble protein C813, bind to the C5b67 complex and inhibit its insertion into the cell membrane. Host cell membranes also contain a membrane-bound protein called HRF (CD59, protectin) which inhibits the binding of C9 to C5b678 to prevent formation of the membrane attack complex on autologous or allogenic cells.

a. Factor I

Factor I (fI) is one of several serine proteases (also including factor D, MBL-associated serine protease (MASP)-2, C1s, C1r, factor B, and C2) of the complement system that play a role in the generation and amplification of the complement cascade reactions. All of the complement serine proteases share domain homology with the trypsin family and share some of the structural attributes that determine substrate specificity. The C-terminus of Factor I is made up of a trypsin-like serine protease light chain that, based on homology to other serine proteases, contains the residues that form the His-Asp-Ser catalytic triad. Additionally, residues are present that define the specificity pocket ($D^{501}$) and the extended substrate binding site $S^{527}$, $W^{528}$, and $G^{529}$ (based on numbering of the mature protein in the absence of the signal peptide, see for example, Tsiftsoglou et al., (2005) *Biochemistry* 44:6239).

Factor I plays a role in modulating complement activation by cleaving C3b and C4b, components of the C3 convertase in the classical, alternative, and lectin pathways thereby inactivating the pathways. Cleavage of fI substrates, C3b and C4b, requires a conformational change in the substrates caused by the formation of a thioester bond. For example, proteolytic activation of C3 to C3b by convertase results in a conformational change from the latent form to the C3b form which leads to reaction of an intramolecular thiolester with nucleophiles, such as water, thereby rendering C3b susceptible to fI cleavage (Ogata et al., (1998) *J Immunol* 161:4785). Reaction of the thioester with water can occur in the absence of convertase cleavage, giving a hydrolyzed inactive form of C3 and C4 termed iC3 and iC4. For example, the iC3 species is a mimic of C3b; iC3 is sensitive to fI cleavage and can substitute for C3b in the C3 and C5 convertases. Generally, cleavage of the C3b and C4b substrates by Factor I requires the formation of a ternary complex with a cofactor protein, such as factor H or C4-binding protein, and MCP. Cleavage of synthetic substrates by Factor I, however, does not require the presence of cofactors (Tsiftsoglou et al., (2004) *J Immunol* 173:367-375). Cleavage by fI is restricted to cleavage of arginyl bonds in the substrate. fI cleavage sites in C3 are LPSR (SEQ ID NO: 388) and SLLR (SEQ ID NO: 389) and a cleavage site in C4 is HRGR (SEQ ID NO:390).

6. Complement-Mediated Diseases and Disorder

By virtue of the pivotal role of the complement system in the etiology of diseases and disorders, the system can serve as a point of therapeutic intervention in such diseases and disorders. The proteases provided herein target this system and permit modulation thereof.

The skilled artisan understands the role of the complement system in disease processes and is aware of a variety of such diseases. The following is a discussion of exemplary diseases and the role of the complement system in their etiology and pathology. Modulation of the complement system by the proteases provided herein can serve to treat such diseases. Diseases can involve complement activation or inhibition.

a. Disease Mediated by Complement Activation

The complement cascade is a dual-edged sword, causing protection against bacterial and viral invasion by promoting phagocytosis and inflammation. Conversely, even when complement is functioning normally, it can contribute to the development of disease by promoting local inflammation and damage to tissues. Thus, pathological effects are mediated by the same mediators that are responsible for the protective roles of complement. For example, the anaphylactic and chemotactic peptide C5a drives inflammation by recruiting and activating neutrophils, C3a can cause pathological activation of other phagocytes, and the membrane attack complex can kill or injure cells. In one example, such as in many autoimmune diseases, complement produces tissue damage because it is activated under inappropriate circumstances such as by antibody to host tissues. In other situations, complement can be activated normally, such as by septicemia, but still contributes to disease progression, such as in respiratory distress syndrome. Pathologically, complement can cause substantial damage to blood vessels (vasculitis), kidney basement membrane and attached endothelial and epithelial cells (nephritis), joint synovium (arthritis), and erythrocytes (hemolysis) if it is not adequately controlled.

Complement has a role in immuno-pathogenesis of a number of disorders, including autoimmune diseases such as rheumatoid arthritis (see, e.g., Wang et al. (1995) *Proc. Natl. Acad. Sci. U.S.A.* 92:8955-8959; Moxley et al. (1987) *Arthritis & Rheumatism* 30:1097-1104), lupus erythematosus (Wang et al. (1996) *Proc. Natl. Acad. Sci. U.S.A.* 90:8563-8568; and Buyon et al. (1992) *Arthritis Rheum.* 35:1028-1037) and acute glomerulonephritis (Couser et al. (1995) *J Am Soc Nephrol.* 5:1888-1894). Other pathologies that involve activation of the complement system include sepsis (see, e.g., Stove et al. (1996) *Clin Diag Lab Immunol* 3:175-183; Hack et al. (1989) *Am. J. Med.* 86:20-26), respiratory distress syndrome (see, e.g., Zilow et al. (1990) *Clin. Exp. Immunol.* 79:151-157; and Stevens et al. (1986) *J. Clin Invest.* 77:1812-1816), multiorgan failure (see, e.g., Hecke et al. (1997) *Shock* 7:74; and Heideman et al. (1984) *J. Trauma* 24:1038-1043) and ischemia-reperfusion injury such as occurs in cardiovascular disease such as stroke or myocardial infarct (Austen W G et al. (2003) *Int J Immunopathol Pharm* 16(1):1-8). Some exemplary examples of complement-mediated disease are described below.

i. Rheumatoid Arthritis

Rheumatoid arthritis (RA) is a chronic inflammatory illness. It is an autoimmune disease in which the immune system attacks normal tissue components as if they were invading pathogens. The inflammation associated with rheumatoid arthritis primarily attacks the linings of the joints. The membranes lining the blood vessels, heart, and lungs also can become inflamed. RA is characterized by activated B cells and plasma cells that are present in inflamed synovium, and in established disease lymphoid follicles and germinal centers. This results in high levels of local immunoglobulin production and the deposition of immune complexes, which can include IgG and IgM rheumatoid factors, in the synovium and in association with articular cartilage which can serve as initiators of the complement cascade. Elevated levels of complement components, such as C3a, C5a, and C5b-9 have been found within the inflamed rheumatoid joints. These complement components can exacerbate the inflammation associated with RA by inducing a variety of proinflammatory activities such as for example, alterations in vascular permeability, leukocyte chemotaxis, and the activation and lysis of multiple cell types.

ii. Sepsis

Sepsis is a disease caused by a serious infection, such as a bacterial infection, leading to a systemic inflammatory response. The bacterial cell wall component, lipopolysaccharide, is often associated with sepsis, although other bacterial, viral, and fungal infections can stimulate septic symptoms. Septic shock often results if the natural immune system of the body is unable to defend against an invading microorganism such that, for example, the pro-inflammatory consequences of the immune response is damaging to host tissues. The early stages of sepsis are characterized by excessive complement activation resulting in increased production of complement anaphylatoxins, such as C3a, C4a, and C5a which act to increase vascular permeability, stimulate superoxide production from neutrophils and stimulate histamine release. The actions of C5a can contribute to a productive immune response to a bacterial infection, but if left unregulated, C5a also can be severely damaging. In an *E. coli*-induced model of inflammation, blockade of C5a improved the outcome of septic animals by limiting C5a-mediated neutrophil activation that can lead to neutrophil-mediated tissue injury.

The continued impairment of the innate immune response to a bacterial infection often leads to chronic sepsis or septic shock, which can be life-threatening. In the late stage of sepsis, it is the "dormant" activity of neutrophils, as opposed to the hyperactivity that occurs in the early phases, that contributes to continued disease. In the late stage, the major functions of neutrophils including chemotaxis, respiratory burst activity, and ability for bacterial killing are reduced. Complement, and in particular C5a, also play a role in the later stages of sepsis. Excessive production of C5a during sepsis is associated with the "deactivation" of blood neutrophils, a process that has been linked to C5a-induced downregulation of its own receptor, C5aR, on neutrophils (Guo et al. (2003) *FASEB J* 13:1889). The reduced levels of C5aR on neutrophils correlates with a diminished ability of blood neutrophils to bind C5a, impaired chemotactic responses, a loss of superoxide productions, and impaired bactericidal activity. C5aR levels, however, can begin to "recover" at later stages of sepsis and correlate with instances of beneficial disease outcome.

iii. Multiple Sclerosis

Multiple sclerosis (MS) and its animal model experimental allergic encephalomyelitis (EAE) are inflammatory demyelinating diseases of the central nervous system (CNS). In MS, inflammation of nervous tissue causes the loss of myelin, a fatty material which acts as a sort of protective insulation for the nerve fibers in the brain and spinal cord. This demyelination leaves multiple areas of scar tissue (sclerosis) along the covering of the nerve cells, which disrupts the ability of the nerves to conduct electrical impulses to and from the brain, producing the various symptoms of MS. MS is mediated by activated lymphocytes, macrophages/microglia and the complement system. Complement activation can contribute to the pathogenesis of these diseases through its dual role: the ability of activated terminal complex C5b-9 to promote demyelination and the capacity of sublytic C5b-9 to protect oligodendrocytes (OLG) from apoptosis.

iv. Alzheimer's Disease

Alzheimer's disease (AD) is characterized by tangles (abnormal paired helical filaments of the protein tau, which normally binds to microtubules) and plaques (extracellular deposits composed primarily of beta-amyloid protein) within the brain. Although, it is not entirely clear what the precise cause of AD is, chronic neuroinflammation in affected regions of AD brains suggests that proinflammatory mediators can play a role. The tangles and plaques within an AD brain are deposited with activated complement fragments, such as for example, C4d and C3d. Likewise, dystrophic neurites in AD brain can be immunostained for MAC, indicating autocatalytic attack of these neurites and concomitant neurite loss in AD. Activation of complement in AD occurs by an antibody-independent mechanism induced by aggregated beta-amyloid protein. Further, the complement cascade can be activated by the pentraxins, C-reactive protein (CRP), and amyloid P (AP) which are all upregulated in AD (McGeer et al., (2002) *Trends Mol Med* 8:519). The activation of complement in AD, marked by increases in complement mediators, is not adequately controlled by a compensatory upregulation of complement regulatory proteins such as, for example, CD59. Thus, the proinflammatory consequences of complement activation exacerbates AD disease progression and likely contributes to neurite destruction.

v. Ischemia-Reperfusion Injury

Ischemia-reperfusion injury is the injury sustained after an ischemic event and subsequent restoration of blood flow and results from the inflammatory response to a hypoxic insult. Ischemia-reperfusion damage can be acute as during cardiac surgery procedures, such as for example following open heart surgery or angioplasty, or chronic as with congestive heart failure or occlusive cardiovascular disease. Examples of injuries that can cause ischemia-reperfusion injury include myocardial infarct (MI) and stroke. The initiation of an inflammatory response is likely caused by the increase in tissue oxygen levels that occur with reperfusion and the concomitant accumulation of metabolites that can generate oxygen free radicals which are immunostimulatory. It is associated with a variety of events including severity of myocardial infarction, cerebral ischemic events, intestinal ischemia, and many aspects of vascular surgery, cardiac surgery, trauma, and transplantation. The injury is manifested by inflammatory events of the innate immune system, particularly activation of the complement system, in response to newly altered tissue as non-self. As such ischemia-reperfusion injury is characterized by tissue edema caused by increased vascular permeability, and an acute inflammatory cell infiltrate caused by influx of polymorphonuclear leukocytes.

Activation of the complement system plays a role in the inflammatory events of ischemia-reperfusion injury. The ischemia injury results in alterations of the cell membrane, affecting lipids, carbohydrates, or proteins of the external surface such that these exposed epitopes are altered and can act as neo-antigens (modified self antigens). Circulating IgM recognize and bind the neo-antigens to form immune complexes on the injured cell surface. The antigen-antibody complexes formed are classic activators of the classical pathway of complement, although all pathways are likely involved in some way to the exacerbating effects of the injury. The involvement of the classical pathway of complement to ischemia-reperfusion injury is evidenced by mice genetically deficient in either C3 or C4 that display equal protection from local injury in a hindlimb and animal model of injury (Austen et al. (2003) *Int J Immunopath Pharm* 16:1). Conversely, in a kidney model of ischemia injury, C3-, C5-, and C6-deficient mice were protected whereas C4-deficient mice were not, suggesting the importance of the alternative complement pathway (Guo et al. (2005) *Ann Rev Immunol* 23:821). Mediators induced upon complement activation initiate an inflammatory response directed at the cell membrane at the site of local injury.

A major effector mechanism of complement in ischemia-reperfusion injury is the influx and activation of neutrophils to the inflamed tissue by complement components, such as for example C5a. Activation of neutrophils results in increased production of reactive oxygen species and the release of lysosomal enzymes in local injured organs which ultimately results in apoptosis, necrosis, and a loss or organ function. The generation of the terminal MAC, C5b-9, also contributes to local tissue injury in ischemia-reperfusion injury.

b. Disease Mediated by Complement Deficiencies

The development of disease also can occur due to the absence of complement components that are important for controlling infection. Complement deficiencies are linked with frequent infections and immune complex diseases. Deficiencies have been identified in all of the complement factors except C9, including Factor D and properdin. Deficiencies also have been identified in the complement regulatory proteins C1INH, Factor I, Factor H, DAF, and HRF.

In general, deficiencies in complement components result in increased bacterial infections due to reduced opsonization and phagocytosis. Typically, deficiencies in complement components that function as opsonins, such as for example C3b, result in increased susceptibility to infection. For example, whereas individuals deficient in any of the late components of complement are relatively unaffected, individuals lacking C3 or any of the molecules that catalyze C3b deposition show increased susceptibility to infection by a wide range of extracellular bacteria. Likewise, people deficient in MBL, which normally functions as a traditional opsonin and as the initiator of the lectin pathway of complement following recognition of foreign pathogens, have increased susceptibility to infection, particularly during early childhood. The role of deficiencies in the late components of complement, including C5-C9 that are involved in the formation of the membrane attack complex, to bacterial infection is more limited. Deficiencies in C5-C9 have only been shown to be associated with susceptibility to infection by *Neisseria* species, the bacteria that causes gonorrhea and bacterial meningitis.

Another consequence of complement deficiency is immune complex disease. Immune complex disease is caused by complement-mediated inflammation in response to persisting antigen-antibody complexes in the circulation and the tissues. Since the early components of the classical complement pathway initiate complement in response to the recognition of antigen-antibody complexes, deficiencies of these early components, such as for example C1q, can cause significant pathology in autoimmune disease such as systemic lupus erythematosus.

Deficiencies in complement regulatory proteins such as Factor H, DAF, and HRF also can result in complement-mediated disease. For example, uncontrolled complement activation can result in depletion of complement proteins resulting in an increased infection by bacteria, particularly ubiquitous pyogenic bacteria. This is the case in genetic factor I deficiency where factor I is not present and unable to inhibit the activation of the C3 convertase. Other examples include the complement regulatory proteins DAF or HRF, which normally function to protect a person's own cell surfaces from complement activation, but when deficient result in the destruction of host red blood cells resulting in the disease paroxysmal nocturnal hemoglobinuria. Deficiencies in C1-inhibitor cause the disease hereditary angioneurotic edema which is a result of the unregulated activity of serine proteinase enzymes including the complement components C1r and C1s, as well as other serine proteinases such as factor XIIa and kallikrein. The result of the unregulated activity of these serine proteinases is the production of a variety of vasoactive mediators, such as C2 kinin that is produced by the activity of C1s and C2a, resulting in fluid accumulation in the tissues and epiglottal swelling that can lead to suffocation.

C. PROTEASES

Provided herein are proteases and methods of using the proteases to cleave (thereby inactivating) proteins involved in disease processes. Typically, a protease provided herein is a non-complement protease that does not normally participate in the complement pathways. Exemplary proteases provided herein cleave any one or more proteins or components of the complement pathway and allelic variants thereof. Cleavage of a complement protein can be an activating cleavage whereby the activity of the complement pathway is enhanced, such as by cleavage of a zymogen to an activated form of a protease or cleavage of a complement protein into its cleavage effector molecules. Cleavage of a complement protein also can be an inhibitory cleavage whereby the activity of the complement protein is diminished. Provided herein are proteases that cleave a complement protein in an inhibitory manner, thereby inhibiting complement activation of any one or more of the complement pathways. The proteases provided herein can be used for modulating complement activation. A protease provided herein can cleave any one or more complement proteins in vitro or in vivo thereby affecting complement activation in vitro or in vivo.

A protease can be any portion of a full-length protease as long as the portion of the protease retains proteolytic activity. For example, a protease can include only the protease domain of a polypeptide or any catalytically active portion thereof. The protease domain can include a single chain protease domain thereof and can be a fusion protein or a conjugate as long as the resulting fusion protein or conjugate retains proteolytic activity.

If a protease, or portion thereof, recognizes a substrate sequence within a target protein or proteins, such as for example a complement protein, (i) that would alter the function i.e. by inactivation of the target protein(s) upon catalysis of peptide bond hydrolysis, and (ii) the target proteins(s) is a point of molecular intervention for a particular disease or diseases, then the engineered protease has a therapeutic effect via a proteolysis-mediated inactivation event. Complement activities that can be altered include, but are not limited to, hemolysis of red blood cells and/or the generation of effector complement cleavage products such as but not limited to C3a, C3b, C4a, C5a, C5b-9, and Bb. Biological activities of complement can be altered in vitro or in vivo. Generally, a complement activity is altered by a protease at least 0.1, 0.5, 1, 2, 3, 4, 5, or 10 fold compared to the absence of a protease. Typically, a biological activity is altered 10, 20, 50, 100 or 1000 fold or more compared to the activity in the absence of the protease. For purposes herein with reference to complement activity, a protease modulates complement activation or a complement-mediated activity.

A protease provided herein can be from any one or more of the serine, cysteine, aspartic, metallo-, or threonine classes or proteases. A protease can be tested to determine if it cleaves any one or more of the complement proteins and/or it can be used as a scaffold to make modifications in any one or more of the amino acid residues that modulates specificity towards a target substrate and/or modulates an activity of a target substrate. Exemplary classes of proteases and amino acid determinants that contribute to substrate specificity are described below.

1. Classes of Proteases

Proteases (also referred to as proteinases or peptidases) are protein-degrading enzymes that recognize sequences of amino acids or a polypeptide substrate within a target protein. Upon recognition of the substrate sequence of amino acids, proteases catalyze the hydrolysis or cleavage of a peptide bond within a target protein. Such hydrolysis of a target protein, depending on the location of the peptide bond within the context of the full-length sequence of the target sequence, can inactivate a target. Proteases are classified based on the way they attack the protein, either exo- or endo-proteases. Proteinases or endopeptidases attack inside the protein to produce large peptides. Peptidases or exopeptidases attack ends or fragments of protein to produce small peptides and amino acids. The peptidases are classified based on their action pattern: aminopeptidase cleaves amino acids from the amino end: carboxypeptidase cleaves amino acids from the carboxyl end, dipeptidyl peptidase cleaves two amino acids; dipeptidase splits a dipeptide, and tripeptidase cleaves an amino acid from a tripeptide. Most proteases are small from 21,000 to 45,000 Daltons. Many proteases are synthesized and secreted as inactive forms called zymogens and subsequently activated by proteolysis. This changes the architecture of the active site of the enzyme.

Several distinct types of catalytic mechanisms are used by proteases (Barret et al. (1994) Meth. Enzymol. 244:18-61; Barret et al. (1994) Meth. Enzymol 244:461-486; Barret et al. (1994) Meth. Enzymol. 248:105-120; Barret et al. (1994) Meth. Enzymol. 248:183-228). Based on their catalytic mechanism, the carboxypeptidases are subdivided into serine-, metallo and cysteine-type carboxypeptidases and the endopeptidases are the serine-, cysteine-, aspartic-, threonine- and metalloendopeptidases. Serine peptidases have a serine residue involved in the active center, the aspartic have two aspartic acids in the catalytic center, cysteine-type peptidases have a cysteine residue, threonine-type peptidases have a threonine residue, and metallo-peptidases use a metal ion in the catalytic mechanism. Generally, proteases can be divided into classes based on their catalytic activity such that classes of proteases can include serine, cysteine, aspartic, threonine, or metallo-proteases. The catalytic activity of the proteases is required to cleave a target substrate. Hence, modification of a protease to alter the catalytic activity of a protease could affect (i.e. enhance specificity/selectivity) the ability of a protease to cleave a substrate.

Each protease has a series of amino acids that lines the active site pocket and makes direct contact with the substrate. Crystallographic structures of peptidases show that the active site is commonly located in a groove on the surface of the molecule between adjacent structural domains, and the substrate specificity is dictated by the properties of binding sites arranged along the groove on one or both sides of the catalytic site that is responsible for hydrolysis of the scissile bond. Accordingly, the specificity of a peptidase is described by the ability of each subsite to accommodate a sidechain of a single amino acid residue. The sites are numbered from the catalytic site, S1, S2 ... Sn towards the N-terminus of the substrate, and S1', S2' ... Sn' towards the C-terminus. The residues they accommodate are numbered P1, P2 ... Pn, and P1', P2' ... Pn', respectively. The cleavage of a target protein is catalyzed between P1 and P1' where the amino acid residues from the N to C terminus of the polypeptide substrate are labeled (Pi, ..., P3, P2, P1, P1', P2', P3', ..., Pj) and their corresponding binding recognition pockets on the protease are labeled (Si, ..., S3, S2, S1, S1', S2', S3', ..., Sj) (Schecter and Berger (1967) Biochem Biophys Res Commun 27:157-162). Thus, P2 interacts with S2, P1 with S1, P1' with S1', etc. Consequently, the substrate specificity of a protease comes from the S1-S4 positions in the active site, where the protease is in contact with the P1-P4 residues of the peptide substrate sequences. In some cases, there is little (if any) interaction between the S1-S4 pockets of the active site, such that each pocket appears to recognize and bind the corresponding residue on the peptide substrate sequence independent of the other pockets. Thus, the specificity determinants can be changed in one pocket without affecting the specificity of the other pocket.

Based upon numerous structures and modeling of family members, surface residues that contribute to extended substrate specificity and other secondary interactions with a substrate have been defined for many proteases including proteases of the serine, cysteine, aspartic, metallo-, and threonine families (see e.g. Wang et al., (2001) Biochemistry 40(34): 10038-46; Hopfner et al., (1999) Structure Fold Des. 7(8):989-96; Friedrich et al. (2002) J Biol. Chem. 277(3): 2160-8; Waugh et al., (2000) Nat Struct Biol. 7(9):762-5; Cameron et al., (1993) J Biol. Chem. 268:11711; Cameron et al., (1994) J Biol. Chem. 269: 11170). A protease can be tested to determine if it cleaves any one or more of the complement proteins and/or it can be used as a scaffold to make modifications in any one or more of the amino acid residues that modulates specificity towards a complement protein target substrate and/or modulates an activity of a complement protein target substrate. To make a modified protease with an altered substrate recognition profile, the amino acids in the three-dimensional structure that contribute to the substrate selectivity (specificity determinants) can be targeted for mutagenesis. Exemplary proteases include, but are not limited to, any protease such as a serine, cysteine, aspartic, metallo-, or threonine protease as described below and provided herein.

a. Serine Proteases

Serine proteases (SPs), which include secreted enzymes and enzymes sequestered in cytoplasmic storage organelles, have a variety of physiological roles, including roles in blood coagulation, wound healing, digestion, immune responses and tumor invasion and metastasis. For example, chymotrypsin, trypsin, and elastase function in the digestive tract; Factor 10, Factor 11, Thrombin, and Plasmin are involved in clotting and wound healing; and C1r, C1s, and the C3 convertases play a role in complement activation as discussed above.

A class of cell surface proteins designated type II transmembrane serine proteases are proteases which are membrane-anchored proteins with extracellular domains. As cell surface proteins, they play a role in intracellular signal transduction and in mediating cell surface proteolytic events. Other serine proteases are membrane bound and function in a similar manner. Others are secreted. Many serine proteases exert their activity upon binding to cell surface receptors, and hence, act at cell surfaces. Cell surface proteolysis is a mechanism for the generation of biologically active proteins that mediate a variety of cellular functions.

Serine proteases, including secreted and transmembrane serine proteases, are involved in processes that include neoplastic development and progression. While the precise role of these proteases has not been fully elaborated, serine proteases and inhibitors thereof are involved in the control of many intra- and extracellular physiological processes, including degradative actions in cancer cell invasion and metastatic spread, and neovascularization of tumors that are involved in tumor progression. Proteases are involved in the degradation and remodeling of extracellular matrix (ECM) and contribute to tissue remodeling, and are necessary for cancer invasion and metastasis. The activity and/or expression of some proteases have been shown to correlate with tumor progression and development.

The activity of proteases in the serine protease family is dependent on a set of amino acid residues that form their active site. One of the residues is always a serine; hence their designation as serine proteases. For example, chymotrypsin, trypsin, and elastase share a similar structure and their active serine residue is at the same position (Ser-195) in all three. Despite their similarities, they have different substrate specificities; they cleave different peptide bonds during protein digestion. For example, chymotrypsin prefers an aromatic side chain on the residue whose carbonyl carbon is part of the peptide bond to be cleaved (R-group). Trypsin prefers a positively charged Lys or Arg residue at this position. Serine proteases differ markedly in their substrate recognition properties: some are highly specific (i.e. the proteases involved in blood coagulation and the immune complement system); some are only partially specific (i.e. the mammalian digestive proteases trypsin and chymotrypsin); and others, like subtilisin, a bacterial protease, are completely non-specific. Despite these differences in specificity, the catalytic mechanism of serine proteases is well conserved.

The mechanism of cleavage of a target protein by a serine protease is based on nucleophilic attack of the targeted peptidic bond by a serine. Cysteine, threonine or water molecules associated with aspartate or metals also can play this role. In many cases the nucleophilic property of the group is improved by the presence of a histidine, held in a "proton acceptor state" by an aspartate. Aligned side chains of serine, histidine and aspartate build the catalytic triad common to most serine proteases. For example, the active site residues of chymotrypsin, and serine proteases that are members of the same family as chymotrypsin, such as for example MT-SP1, are Asp102, His57, and Ser195. Over 20 families (denoted S1-S27) of serine protease have been identified, these being grouped into 6 clans (SA, SB, SC, SE, SF and SG) on the basis of structural similarity and other functional evidence (Rawlings N D et al. (1994) *Meth. Enzymol.* 244: 19-61). There are similarities in the reaction mechanisms of several serine peptidases. Chymotrypsin, subtilisin and carboxypeptidase C clans have a catalytic triad of serine, aspartate and histidine in common: serine acts as a nucleophile, aspartate as an electrophile, and histidine as a base. The geometric orientations of the catalytic residues are similar between families, despite different protein folds. The linear arrangements of the catalytic residues commonly reflect clan relationships. For example the catalytic triad in the chymotrypsin clan (SA) is ordered HDS, but is ordered DHS in the subtilisin clan (SB) and SDH in the carboxypeptidase clan (SC).

Throughout the chymotrypsin family of serine proteases, the backbone interaction between the substrate and enzyme is completely conserved, but the side chain interactions vary considerably. The identity of the amino acids that contain the S1-S4 pockets of the active site determines the substrate specificity of that particular pocket. Grafting the amino acids of one serine protease to another of the same fold modifies the specificity of one to the other. Typically, the amino acids of the protease that contain the S1-S4 pockets are those that have side chains within 4 to 5 angstroms of the substrate. The interactions these amino acids have with the protease substrate are generally called "first shell" interactions because they directly contact the substrate. There, however, can be "second shell" and "third shell" interactions that ultimately position the first shell amino acids. First shell and second shell substrate binding effects are determined primarily by loops between beta-barrel domains. Because these loops are not core elements of the protein, the integrity of the fold is maintained while loop variants with novel substrate specificities can be selected during the course of evolution to fulfill necessary metabolic or regulatory niches at the molecular level. Typically for serine proteases, the following amino acids in the primary sequence are determinants of specificity: 195, 102, 57 (the catalytic triad); 189, 190, 191, 192, and 226 (S1); 57, the loop between 58 and 64, and 99 (S2); 192, 217, 218 (S3); the loop between Cys168 and Cys180, 215, and 97 to 100 (S4); and 41 and 151 (S2'), based on chymotrypsin numbering, where an amino acid in an S1 position affects P1 specificity, an amino acid in an S2 position affects P2 specificity, an amino acid in the S3 position affects P3 specificity, and an amino acid in the S4 position affects P4 specificity. Position 189 in a serine protease is a residue buried at the bottom of the pocket that determines the S1 specificity. Structural determinants for various serine proteases are listed in Table 9 with numbering based on the numbering of mature chymotrypsin, with protease domains for each of the designated proteases aligned with that of the protease domain of chymotrypsin. The numbers underneath the Cys168-Cys182 and 60's loop column headings indicate the number of amino acids in the loop between the two amino acids and in the loop. The yes/no designation under the Cys191-Cys220 column headings indicates whether the disulfide bridge is present in the protease. These regions are variable within the family of chymotrypsin-like serine proteases and represent structural determinants in themselves. Modification of a protease to alter any one or more of the amino acids in the S1-S4 pocket affects the specificity or selectivity of a protease for a target substrate.

TABLE 9

The structural determinants for various serine proteases
Residues that Determine Specificity

| | S4 | | | | | S3 | | S2 | | | S1 | | | |
| --- | --- | --- | --- | --- | --- | --- | --- | --- | --- | --- | --- | --- | --- | --- |
| | | | | | Cys168 | | | | | 60's | | | | Cys191 |
| | 171 | 174 | 180 | 215 | Cys182 | 192 | 218 | 99 | 57 | loop | 189 | 190 | 226 | Cys220 |
| Granzyme B | Leu | Tyr | Glu | Tyr | 14 | Arg | Asn | Ile | His | 6 | Gly | Ser | Arg | No |
| Granzyme A | Asn | Val | Met | Phe | 17 | Asn | Leu | Arg | His | 7 | Asp | Ser | Gly | Yes |
| Granzyme M | Arg | Ser | Met | Phe | 15 | Lys | Arg | Leu | His | 8 | Ala | Pro | Pro | Yes |
| Cathepsin G | Phe | Ser | Gln | Tyr | 13 | Lys | Ser | Ile | His | 6 | Ala | Ala | Glu | No |
| MT-SP1 | Leu | Gln | Met | Trp | 13 | Gln | Asp | Phe | His | 16 | Asp | Ser | Gly | Yes |
| Neutrophil elastase | — | — | — | Tyr | 5 | Phe | Gly | Leu | His | 10 | Gly | Val | Asp | Yes |
| Chymase | Phe | Arg | Gln | Tyr | 12 | Lys | Ser | Phe | His | 6 | Ser | Ala | Ala | No |
| Alpha-tryptase | Tyr | Ile | Met | Trp | 22 | Lys | Glu | Ile | His | 9 | Asp | Ser | Gly | Yes |
| Beta-tryptase(I) | Tyr | Ile | Met | Trp | 22 | Gln | Glu | Val | His | 9 | Asp | Ser | Gly | Yes |
| Beta-tryptase (II) | Tyr | Ile | Met | Trp | 22 | Lys | Glu | Thr | His | 9 | Asp | Ser | Gly | Yes |
| Chymotrypsin | Trp | Arg | Met | Trp | 13 | Met | Ser | Val | His | 7 | Ser | Ser | Gly | Yes |
| Easter | Tyr | Ser | Gln | Phe | 16 | Arg | Thr | Gln | His | 14 | Asp | Ser | Gly | Yes |
| Collagenase | Tyr | Ile | — | Phe | 12 | Asn | Ala | Ile | His | 8 | Gly | Thr | Asp | Yes |
| Factor Xa | Ser | Phe | Met | Trp | 13 | Gln | Glu | Tyr | His | 8 | Asp | Ala | Gly | Yes |
| Protein C | Met | asn | Met | Trp | 13 | Glu | Glu | Thr | His | 8 | Asp | Ala | Gly | Yes |

TABLE 9-continued

The structural determinants for various serine proteases
Residues that Determine Specificity

| | S4 | | | | | S3 | | S2 | | | S1 | | | |
|---|---|---|---|---|---|---|---|---|---|---|---|---|---|---|
| | | | | | Cys168 | | | | 60's | | | | | Cys191 |
| | 171 | 174 | 180 | 215 | Cys182 | 192 | 218 | 99 | 57 | loop | 189 | 190 | 226 | Cys220 |
| Plasma kallikrein | Tyr | Gln | Met | Tyr | 13 | Arg | Pro | Phe | His | 11 | Asp | Ala | Ala | Yes |
| Plasmin | Glu | Arg | Glu | Trp | 15 | Gln | Leu | Thr | His | 11 | Asp | Ser | Gly | Yes |
| Trypsin | Tyr | Lys | Met | Trp | 13 | Gln | Tyr | Leu | His | 6 | Asp | Ser | Gly | Yes |
| Thrombin | Thr | Ile | Met | Trp | 13 | Glu | Glu | Leu | His | 16 | Asp | Ala | Gly | Yes |
| tPA | Leu | Thr | Met | Trp | 15 | Gln | Leu | Tyr | His | 11 | Asp | Ala | Gly | Yes |
| uPA | His | Ser | Met | Trp | 15 | Gln | Arg | His | His | 11 | Asp | Ser | Gly | yes | i. MT-SP1

Exemplary of the scaffold protease contemplated for use in modulating complement activation or as a scaffold for further modification to increase its activity in modulating the complement pathway is membrane-type serine protease MT-SP1 (also called matriptase, TADG-15, suppressor of tumorigenicity 14, ST14); see SEQ ID NOS: 1, 2 and GenBank Accession Nos: AF118224 and AAD42765; (1999) *J. Biol. Chem.* 274:18231-18236; U.S. Pat. No. 5,792,616; see, also Takeuchi (1999) *Proc. Natl. Acad. Sci. U.S.A.* 96:11054-1161. The protein designated herein as an exemplary scaffold is a 855 amino acid MT-SP1 protease (see SEQ ID NOS: 1 and 2). The nucleic acid molecule whose sequence is set forth in SEQ ID NO:1 (see, also Genbank AF118224) encodes the 855 amino acid MT-SP1 (SEQ ID NO: 2, GenBank AAD42765).

It is multidomain proteinase with a C-terminal serine proteinase domain (Friedrich et al. (2002) J Biol Chem 277(3):2160). A 683 amino acid variant of the protease has been isolated, but this protein appears to be a truncated form or an ectodomain form.

MT-SP1 is highly expressed or active in prostate, breast, and colorectal cancers and it may play a role in the metastasis of breast and prostate cancer. MT-SP1 also is expressed in a variety of epithelial tissues with high levels of activity and/or expression in the human gastrointestinal tract and the prostate. Other species of MT-SP1 are known. For example, a mouse homolog of MT-SP1 has been identified and is called epithin.

MT-SP1 contains a transmembrane domain, two CUB domains, four LDLR repeats, and a serine protease domain (or peptidase S1 domain) between amino acids 615-854 (set forth as SEQ ID NOS:9 and 10), which is highly conserved among all members of the peptidase S1 family of serine proteases, such as for example with chymotrypsin (SEQ ID NOS:7 and 8). MT-SP1 is synthesized as a zymogen, and activated to double chain form by cleavage. In addition, the single chain proteolytic domain alone is catalytically active and functional.

MT-SP1 belongs to the peptidase S1 family of serine proteases (also referred to as the chymotrypsin family), which also includes chymotrypsin and trypsin. Generally, chymotrypsin family members share sequence and structural homology with chymotrypsin. MT-SP1 is numbered herein according to the numbering of mature chymotrypsin, with its protease domain aligned with that of the protease domain of chymotrypsin and its residues numbered accordingly. Based on chymotrypsin numbering, active site residues are Asp102, His57, and Ser195. The linear amino acid sequence can be aligned with that of chymotrypsin and numbered according to the β sheets of chymotrypsin. Insertions and deletions occur in the loops between the beta sheets, but throughout the structural family, the core sheets are conserved. The serine proteases interact with a substrate in a conserved beta sheet manner. Up to 6 conserved hydrogen bonds can occur between the substrate and enzyme. All serine proteases of the chymotrypsin family have a conserved region at their N-terminus of the protease domain that is necessary for catalytic activity (i.e. IIGG (SEQ ID NO: 714), VVGG (SEQ ID NO: 712), or IVGG (SEQ ID NO:715), where the first amino acid in this quartet is numbered according to the chymotrypsin numbering and given the designation Ile16. This numbering does not reflect the length of the precursor sequence).

The substrate specificity of MT-SP1 in the protease domain has been mapped using a positional scanning synthetic combinatorial library and substrate phage display (Takeuchi et al. (2000) *J Biol Chem* 275: 26333). Cleavage residues in substrates recognized by MT-SP1 contain Arg/Lys at P4 and basic residues or Gln at P3, small residues at P2, Arg or Lys at P1, and Ala at P1'. Effective substrates contain Lys-Arg-Ser-Arg (SEQ ID NO: 716) in the P4 to P1 sites, respectively. Generally, the substrate specificity for MT-SP1 reveals a trend whereby if P3 is basic, then P4 tends to be non-basic; and if P4 is basic, then P3 tends to be non-basic. Known substrates for MT-SP1, including, for example, proteinase-activated receptor-2 (PAR-2), single-chain uPA (sc-uPA), the proform of MT-SP1, and hepatocyte growth factor (HGF), conform to the cleavage sequence for MT-SP1 specific substrates.

MT-SP1 can cleave selected synthetic substrates as efficiently as trypsin, but exhibit a more restricted specificity for substrates than trypsin. The catalytic domain of MT-SP1 has the overall structural fold of a (chymo) trypsin-like serine protease, but displays unique properties such as a hydrophobic/acidic S2/S4 subsites and an exposed 60 loop. Similarly, MT-SP1 does not indiscriminately cleave peptide substrates at accessible Lys or Arg residues, but requires recognition of additional residues surrounding the scissile peptide bond. This requirement for an extended primary sequence highlights the specificity of MT-SP1 for its substrates. For example, although MT-SP1 cleaves proteinase activated receptor-2 (PAR-2) (displaying a P4 to P1 target sequence of Ser-Lys-Gly-Arg (SEQ ID NO: 717)), the enzyme does not activate proteins closely related to this substrate such as PAR-1, PAR-3, and PAR-4 that do not display target sequences matching the extended MT-SP1 specificity near the scissile bond (see Friedrich et al. (2002) *J Biol Chem* 277: 2160).

The protease domain of MT-SP1 (see, e.g, SEQ ID NOS: 9 and 10) is composed of a pro-region and a catalytic domain. The catalytically active portion of the polypeptide begins after the autoactivation site at amino acid residue 611 of the mature protein (see, e.g., SEQ ID NOS: 1 and 2 at RQAR (SEQ ID NO: 401) followed by the residues VVGG (SEQ ID NO: 712)). The S1 pocket of MT-SP1 and trypsin are similar with good complementarity for Lys as well as Arg P1 residues, thereby accounting for some similarities in substrate cleavage with trypsin. The accommodation of the P1-Lys residues is mediated by $Ser^{190}$ whose side chain provides an additional hydrogen bond acceptor to stabilize the buried α-ammonium group (see Friedrich et al. (2002) *J Biol Chem* 277: 2160). The S2 pocket is shaped to accommodate small to medium-sized hydrophobic side chains of P2 amino acids and generally accepts a broad range of amino acids at the P2 position. Upon substrate binding, the S2 sub-site is not rigid as evidenced by the rotation of the $Phe^{99}$ benzyl group. Association of the substrate amino acids at positions P3 (for either Gln or basic residues) and P4 (for Arg or Lys residues) appears to be mediated by electrostatic interactions in the S3 and S4 pockets with the acidic side chains of Asp-217 and/or Asp-96 which could favorably pre-orient specific basic peptide substrates as they approach the enzyme active site cleft. The side chain of a P3 residue also is able to hydrogen bond the carboxamide group of $Gln^{192}$ or alternatively, the P3 side chain can extend into the S4 sub-site to form a hydrogen bond with $Phe^{97}$ thereby weakening the inter-main chain hydrogen bonds with $Gly^{216}$. In either conformation, a basic P3 side chain is able to interact favorably with the negative potential of the MT-SP1 S4 pocket. The mutual charge compensation and exclusion from the same S4 site explains the low probability of the simultaneous occurrence of Arg/Lys residues at P3 and P4 in good MT-SP1 substrates. Generally, the amino acid positions of MT-SP1 (based on chymotrypsin numbering) that contribute to extended specificity for substrate binding include: 146 and 151 (S1'); 189, 190, 191, 192, 216, 226 (S1); 57, 58, 59, 60, 61, 62, 63, 64, 99 (S2); 192, 217, 218, 146 (S3); 96, 97, 98, 99, 100, 168, 169, 170, 170A, 171, 172, 173, 174, 175, 176, 178. 179, 180, 215, 217, 224 (S4). Table 10 summarizes the residues in MT-SP1 for some of the amino acid positions important for specificity interactions with a targeted substrate. Typically, modification of an MT-SP1 protease to alter any one or more of the amino acids in the extended specificity binding pocket or other secondary sites of interaction affect the specificity or selectivity of a protease for a target substrate.

TABLE 10

Structural determinants for MT-SP1 substrate cleavage
Residues that Determine Specificity

| S4 | | | | | S3 | | S2 | | | S1 | | | |
|---|---|---|---|---|---|---|---|---|---|---|---|---|---|
| | | | | | | | | | 60's loop | | | | |
| 171 | 174 | 180 | 215 | Cys168 Cys182 | 192 | 218 | 99 | 57 | (58-64) | 189 | 190 | 226 | Cys191 Cys220 |
| Leu | Gln | Met | Trp | 13 | Gln | Asp | Phe | His | 16 | Asp | Ser | Gly | yes | ii. Granzyme B

Granzyme B also is exemplary of the scaffold proteases contemplated for use in modulating complement activation or for further modification to increase its activity in modulating a complement pathway. Granzyme B is a serine protease (S1-type) necessary for target cell lysis in cell-mediated immune responses. Granzyme B is linked to an activation cascade of caspases (aspartate-specific cysteine proteases) responsible for apoptosis execution and cleaves caspase-3, caspase-7, caspase-9 and caspase-10 to give rise to active enzymes mediating apoptosis. Granzyme B (SEQ ID NO:3, GenBank Accession Number: M17016) encodes a 247 amino acid polypeptide (SEQ ID NO: 4, GenBank Accession No.: P10144). The precursor granzyme B polypeptide has a signal sequence and propeptide activation peptide at amino acids 1 to 20. The mature granzyme B protein is characterized by a peptidase S1 or protease domain at amino acids 21-245.

Granzyme B is a member of the family of chymotrypsin fold serine proteases, and has greater than 50% identity to other members of the granzyme family including granzymes C-G, cathepsin G, and rat mast cell protease II. The protein is a sandwich of two six stranded, anti-parallel beta-barrel domains connected by a short alpha-helix.

A substrate cleavage site of wildtype granzyme B has a consensus recognition site of I/V (P4)-E/Q/M (P3)-P/T (P2)-D (P1). These amino acids line the P1-P4 pocket of the substrate for recognition and cleavage by granzyme B. Generally granzyme B has a preference for cleaving after Asp in its consensus recognition.

The structural determinants for granzyme B substrate cleavage have been identified by the three-dimensional structure of rat granzyme B (SEQ ID NOS: 5 and 6) in complex with ecotin (IEPD), a macromolecular inhibitor with a substrate-like binding loop (Waugh et al., (2000) *Nature Struct. Biol* 7:762). The catalytic triad is composed of Asp102, His57 and Ser195. The surface loops are numbered according to the additions and deletions compared to alpha-chymotrypsin and represent the most variable regions of this structural family. Other structural determinants of specificity include Lys41, Ile99, Arg192, Asn218, Tyr215, Tyr174, Leu172, Arg226, and Tyr151, by chymotrypsin numbering. The other members of the granzyme family of serine proteases share only two of these amino acids with granzyme B. They are Tyr215 and Leu172, two residues that vary very little across the entire structural family. This indicates that while the sequence identity of the granzymes is high, their substrate specificities are very different. The structural determinants for granzyme B substrate specificity are listed in Table 11 with chymotrypsin numbering. Typically, modification of a granzyme B protease to alter any one or more of the amino acids in the extended specificity binding pocket, or other secondary sites of interactions, affects the specificity or selectivity of a protease for a target substrate including a complement protein target substrate.

TABLE 11

Structural determinants for Granzyme B substrate cleavage
Residues that Determine Specificity

| S4 | | | | | | | S2 | | | S1 | | | |
|---|---|---|---|---|---|---|---|---|---|---|---|---|---|
| | | | | Cys168 | S3 | | | 60's | | | | | Cys191 |
| 171 | 174 | 180 | 215 | Cys182 | 192 | 218 | 99 | 57 | loop | 189 | 190 | 226 | Cys220 |
| Leu | Tyr | Glu | Tyr | 14 | Arg | Asn | Ile | His | 6 | Gly | Ser | Arg | no |

The importance of granzyme B structural determinants to specificity has been profiled using a combinatorial substrate library to determine the effect of a mutation on extended specificity. Mutation of Ile99, Arg192, Asn218 and Tyr174 to the amino acid alanine have shown that Ile99 contributes to P2 specificity, Asn218 and Arg192 to P3 specificity, and Tyr174 to P4 specificity. Since the P1 specificity of a protease represents the majority of its specificity, the modifications do not destroy unique specificity of granzyme B towards P1 aspartic acid amino acids but modulate specificity in the extended P2 to P4 sites. For the P3 and P4 subsites, mutations at Tyr174, Arg192 and Asn218 did not significantly affect the specificity. Y174A increases the activity towards Leu at P4, but the rest of the amino acids continue to be poorly selected. R192A and N218A both broaden the specificity at P3. Instead of a strong preference for glutamic acid, Ala, Ser, Glu and Gln are introduced into a modified protease. The overall activity ($k_{cat}/K_m$) of the mutant is less than 10% below the wild-type activity toward an ideal wild-type substrate, N-acetyl-Ile-Glu-Pro-Asp-AMC (7-amino-4-methylcoumarin) (Ac-IEPD-AMC). A greater effect is observed at the P2 subsite. In wildtype granzyme B, the preference is broad with a slight preference for Pro residues. I99A narrows the P2 specificity to Phe and Tyr residues. Phe narrows specificity by nearly 5 times over the average activity of other amino acids at this position. Within the chymotrypsin family of serine proteases, more than a dozen proteases have a small residue at this structural site, either an asparagine, serine, threonine, alanine or glycine. From this group, two proteases have been profiled using combinatorial substrate libraries, (plasma kallikrein and plasmin), and both show strong preferences towards Phe and Tyr. These two results suggest that any serine protease that is mutated to an Asn, Ser, Thr, Gly or Ala at position 99 will show the same hydrophobic specificity found in plasma kallikrein, plasmin and the I99A granzyme B mutant.

P2 specificity determinants can be expanded to the contrasting mutation and substrate preference. For example, nearly two dozen chymotrypsin-fold serine proteases have an aromatic amino acid at position 99. Four of these proteases have been profiled using combinatorial substrate libraries: human granzyme B, tissue type plasminogen activator, urokinase type plasminogen activator, and membrane type serine protease 1. All but granzyme B have a preference for serine, glycine and alanine amino acids at the substrate P2 position.

b. Cysteine Proteases

Cysteine proteases have a catalytic mechanism that involves a cysteine sulfhydryl group. Deprotonation of the cysteine sulfhydryl by an adjacent histidine residue is followed by nucleophilic attack of the cysteine on the peptide carbonyl carbon. A thioester linking the new carboxy-terminus to the cysteine thiol is an intermediate of the reaction (comparable to the acyl-enzyme intermediate of a serine protease). Cysteine proteases include papain, cathepsin, caspases, and calpains.

Papain-like cysteine proteases are a family of thiol dependent endo-peptidases related by structural similarity to papain. They form a two-domain protein with the domains labeled R and L (for right and left) and loops from both domains form a substrate recognition cleft. They have a catalytic triad made up of the amino acids Cys25, His159, and Asn175. Unlike serine proteases which recognize and proteolyze a target peptide based on a beta-sheet conformation of the substrate, this family of proteases does not have well-defined pockets for substrate recognition. The main substrate recognition occurs at the P2 amino acid (compared to the P1 residue in serine proteases).

The substrate specificity of a number of cysteine proteases (human cathepsin L, V, K, S, F, B, papain, and cruzain) has been determined using a complete diverse positional scanning synthetic combinatorial library (PS-SCL). The complete library contains P1, P2, P3, and P4 tetrapeptide substrates in which one position is held fixed while the other three positions are randomized with equal molar mixtures of the 20 possible amino acids, giving a total diversity of 160,000 tetrapeptide sequences.

Overall, P1 specificity is almost identical between the cathepsins, with Arg and Lys being strongly favored while small aliphatic amino acids are tolerated. Much of the selectivity is found in the P2 position, where the human cathepsins are strictly selective for hydrophobic amino acids. Interestingly, P2 specificity for hydrophobic residues is divided between aromatic amino acids such as Phe, Tyr, and Trp (cathepsin L, V), and bulkly aliphatic amino acids such as Val or Leu (cathepsin K, S, F). Compared to the P2 position, selectivity at the P3 position is significantly less stringent. Several of the proteases, however, have a distinct preference for proline (cathepsin V, S, and papain), leucine (cathepsin B), or arginine (cathepsin S, cruzain). The proteases show broad specificity at the P4 position, as no one amino acid is selected over others.

The S2 pocket is the most selective and best characterized of the protease substrate recognition sites. It is defined by the amino acids at the following spatial positions (papain numbering): 66, 67, 68, 133, 157, 160, and 205. Position 205 plays a role similar to position 189 in the serine proteases—a residue buried at the bottom of the pocket that determines the specificity. The other specificity determinants include the following amino acids (numbering according to papain): 61 and 66 (S3); 19, 20, and 158 (S1). The structural determinant for various cysteine proteases are listed in Table 12. Typically, modification of a cysteine protease, such as for example a papain protease, to alter any one or more of the amino acids in the extended specificity binding pocket or other secondary sites of interaction affect the specificity or selectivity of a protease for a target substrate including a complement protein target substrate.

TABLE 12

The structural determinants for various cysteine proteases
Residues that Determine Specificity

| | Active Site Residues | | | S3 | | S2 | | | | | S1 | | |
|---|---|---|---|---|---|---|---|---|---|---|---|---|---|
| | 25 | 159 | 175 | 61 | 66 | 66 | 133 | 157 | 160 | 205 | 19 | 20 | 158 |
| Cathepsin L | Cys | His | Asn | Glu | Gly | Gly | Ala | Met | Gly | Ala | Gln | Gly | Asp |
| Cathepsin V | Cys | His | Asn | Gln | Gly | Gly | Ala | Leu | Gly | Ala | Gln | Lys | Asp |
| Cathepsin K | Cys | His | Asn | Asp | Gly | Gly | Ala | Leu | Ala | Leu | Gln | Gly | Asn |
| Cathepsin S | Cys | His | Asn | Lys | Gly | Gly | Gly | Val | Gly | Phe | Gln | Gly | Asn |
| Cathepsin F | Cys | His | Asn | Lys | Gly | Gly | Ala | Ile | Ala | Met | Gln | Gly | Asp |
| Cathepsin B | Cys | His | Asn | Asp | Gly | Gly | Ala | Gly | Ala | Glu | Gln | Gly | Gly |
| Papain | Cys | His | Asn | Tyr | Gly | Gly | Val | Val | Ala | Ser | Gln | Gly | Asp |
| Cruzain | Cys | His | Asn | Ser | Gly | Gly | Ala | Leu | Gly | Glu | Gln | Gly | Asp | c. Aspartic Proteases

Aspartate proteases include the digestive enzyme pepsin, some proteases found in lysosomes, the kidney enzyme renin, and the HIV-protease. Two aspartate residues participate in acid/base catalysis at the active site. In the initial reaction, one aspartate accepts a proton from an active site $H_2O$, which attacks the carbonyl carbon of the peptide linkage. Simultaneously, the other aspartate donates a proton to the oxygen of the peptide carbonyl group. They can exhibit a variety of specificities, but typically cleave between two hydrophobic amino acids. Well defined S4, S3, S2, S1, S1', S2', S3', and S4' subsite pockets for the amino acid side chains of the substrate are hallmarks for these enzymes (see e.g. Brinkworth et al., (2001) *J Biol Chem* 276:38844).

Exemplary aspartic proteases include retroviral proteases, such as the human immunodeficiency virus, type 1 (HIV-1) PR, or the avian myeloblastosis/Rous sarcoma virus (AMV/RSV) PR (Cameron et al., (1993) *J Biol. Chem.* 268:11711). The PRs possess substrate binding pockets that contain at least seven subsites (S4-S3') which interact with 7 amino acids of the substrate (P4-P3') (Cameron et al., (1993) *J Biol. Chem.* 268:11711; Cameron et al., (1994) *J Biol. Chem.* 269:11170). Residues that contribute to substrate specificity of the AMV/RSV PR include P62, I42, M73, R105', H7', Q63, R10', D41, I64 (S4); H65, V104', R105', G106', Q63, R10', L35', D37', G39, D41, G66, I67, I108', R111 (S3); I42, I44, H65, M73, A100, A40, D41, I64, G66, I67', I108 (S2); H65, V104', R105', G106', S107', R10', L35', D37', D37, G39, G66, I67, I108' (S1); H65', V104, R105, G106, 5107, R10, L35, D37, D37', G39', G66', I67', I108 (S1), I42', I44', H65', M73', A100', V104', A40', D41', I64', G66', I67, I108' (S2'); and S38', H65', V104, R105, G106, Q63', R10, L35, G39', D41', I64', G66', I67', I108, R111' (S3'), where the amino acid residues in the second subunit of the dimer are indicated by a prime. Residues that contribute to substrate specificity of the HIV-1 PR include D30, V56, P81', R8', D29, I47 (S4); G48, T80', P81' V82', R8', L23', D25', G27, D29, G49, I50, I84', R87 (S3); D30, V32, G48, V56, L76, A28, D29, I47, G49, I50', I84 (S2); G48, T80', P81', V82', N83', R8', L23', D25', D25, G27, G49, I50, I84' (S1); G48', T80, P81, V82, N83, R8, L23, D25, D25', G27', G49', I50', I84 (S1'); D30', V32', G48', V56', L76', T80' (S2'); and R8, L23, G27', D29', I47', G49', I50', I84, R87' (S3'), where the amino acid residues in the second subunit of the dimer are indicated by a prime. Typically, modification of an aspartic protease, such as for example a retroviral protease, to alter any one or more of the amino acids in the extended specificity binding pocket, or other secondary sites of interaction, affects the specificity or selectivity of a protease for a target substrate including a complement protein target substrate.

d. Metalloproteases

Metalloproteases (also called Zinc proteases) include the digestive enzymes carboxypeptidases, various matrix metalloproteases (MMPs) that are secreted by cells, ADAMs (a disintegrin and metalloprotease domain), and lysosomal proteases. These enzymes, including ADAMs and MMPs have roles in embryonic development, cell growth and proliferation, inflammatory responses, wound repair, multiple sclerosis, arthritis, and cancer progression and metastasis (Manzetti et al., (2003) *J of Computer-Aided Mol. Design,* 17: 551). Some MMPs (e.g., collagenase) are involved in degradation of the extracellular matrix during tissue remodeling. For example, many of these enzymes can cleave components of the basement membrane and extracellular matrix. Some MMPs have roles in cell signaling relating to their ability to release cytokines or growth factors, such as TNFα, TGFβ, and interleukins, from the cell surface by cleavage of membrane-bound pre-proteins.

A zinc binding motif at the active site of a metalloprotease includes two histidine residues whose imidazole side-chains are ligands to the $Zn^{++}$. During catalysis, the $Zn^{++}$ promotes nucleophilic attack on the carbonyl carbon by the oxygen atom of a water molecule at the active site. An active site base (a glutamate residue in carboxypeptidase) facilitates this reaction by extracting a proton from the attacking water molecule. Generally, these enzymes have a common zinc binding motif (HExxHxxGxxH) in their active site, and a conserved methionine turn following the active site. Mutation of any one of the histidines ablates catalytic activity. The active site specificity differs between metalloproteases to accommodate different peptide backbones of substrates around the scissile bond. A crucial molecular determinant of MMP substrate specificity is the side chain of the amino acid at the P1' position. Thus, the S1' subsite is important in determining the peptide bond preference for cleavage. For example, the small S1' pocket of MMP-1 and MMP-7 promotes a preference for small hydrophobic residues while other MMPs have large S1' pockets (Overall et al., (2002) *Mol Biotech* 22:51). The S2 position also is a molecular determinant of specificity. For example, between MMP-2 and MMP-9, the S2 sub-site is one of the few differences between the catalytic clefts of the MMPs where the presence of $Glu^{412}$ in MMP-2 versus $Asp^{410}$ in MMP-9 play important roles in altering substrate specificity. In fact, among the larger MMP family the $Glu^{412}$ position is highly variable where it is occupied by acidic residues, large hydrophobic residues, and even glycine. In contrast, most of the residues surrounding the S2 subsite are strictly conserved among all MMPs (Chen et al., (2003) *J Biol Chem* 278:17158). Other molecular determinants of specificity are described in Table 13 below (see e.g., Manzetti et al., (2003) *J Computer-Aided Mol Design* 17:551). Typically, modification of a metalloprotease, such as for example a MMP or ADAM protease, to alter any one or more of the amino acids in the extended specificity binding pocket, or other secondary sites of interaction, affect the specificity or selectivity of a protease for a target substrate including a complement protein target substrate.

TABLE 13

The structural determinants for various metalloproteases

| | S4 | S3 | S2 | S1 | S1' | S2' | S3' | S4' |
|---|---|---|---|---|---|---|---|---|
| MMP-3 | F210 F83 | F210 A169 | H166 H211 | L164 V198 P221 | V163 | L164 | L164 | L222 |
| ADAM9 | F317 V318 H357 | V318 M315 | V318 H351 N356 | M315 H357 | I344 A313 N373 | N373 T312 | S374 F333 | G310 |
| ADAM10 | P391 V332 W331 | V332 P391 N387 | V332 H392 | L329 H392 | L327 T379 A418 | V326 | N366 | T421 | e. Threonine

Threonine proteases include the proteasome hydrolase. The proteasome is a large barrel-shaped protein complex made up of alpha and beta subunits. The beta subunits supply the catalytic machinery found within the two central rings of the complex. Typically, the mechanism of catalysis of the catalytically active beta subunit involves a conserved N-terminal threonine at each active site. The beta subunits become activated when the N-terminus is cleaved off, making threonine the N-terminal residue such that catalytic threonines are exposed at the lumenal surface. Hydrolysis is initiated by attack of an amide bond by the hydroxyl nucleophile on the catalytic machinery. The structural determinants of specificity of the beta subunits of the proteasome have been determined, such as, for example by using libraries of peptide-based covalent inhibitors of the proteasome (see e.g., Groll et al., (2002) *Chem Biol* 9:655; Zhang et al., (2003) *EMBO J,* 22:1488).

D. SCAFFOLD PROTEINS

Scaffold proteins are provided. Scaffold proteins include any wild-type protease so long as they are non-complement proteases, and also include allelic or species variants, or catalytically active portions thereof. The scaffold proteases can be used to target (i.e. cleave) any one or more complement pathway substrates. Typically, such cleavage results in inactivation of a complement pathway. In some instances, such cleavage can result in activation of complement. Hence, such scaffold proteases can be used as therapeutics by targeting complement pathway substrates to, for example, inhibit complement activation which is associated with the etiology of various diseases or disorders. Scaffold proteins also are any proteins that can be modified to cleave a target substrate. Among them are scaffold proteases, whose target substrate specificity can be modified. Scaffold proteins, including proteases, can be modified in any one or more amino acids such that the resulting protease exhibits altered specificity or selectivity for any one or more protein components of the complement pathway and/or modulates an activity of a complement protein or pathway. For example, a modified protease can have an altered substrate specificity such that the modified protease preferentially cleaves a targeted substrate component of the complement pathway compared to a non-targeted substrate, such as for example a native substrate of a wildtype scaffold protease. In one embodiment, the specificity can be increased compared to the specificity of a wildtype or scaffold protease for a targeted substrate. In another example, a modified protease can exhibit a selectivity for a complement component such that the ability of a modified protease to cleave a particular substrate is greater than any other target substrate for which the modified protease also can exhibit specificity. Additionally, a modified protease can cleave a target substrate, such as for example any one or more proteins of a complement pathway, and modulate an activity of a complement pathway.

Exemplary scaffold proteases that can be used to cleave any one or more complement protein or can be used as a template to make modifications in the protease to increase substrate specificity or activity towards any one or more of the complement proteins are described. Protease scaffolds include any non-complement protease that is any one of the serine, cysteine, aspartic, metallo-, or threonine classes of proteases. Exemplary scaffold proteases are listed in Table 14 and described herein. Protease scaffolds include allelic variant and isoform of any one protein, including the scaffold protease polypeptides exemplified in any of SEQ ID NOS: 2, 4, 8, 71, 73, 75, 77, 79, 81, 83, 85, 87, 89, 91, 93, 95, 97, 99, 101, 103, 105, 107, 109, 111, 113, 115, 117, 119, 121, 123, 125, 127, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 269, 270, 272, 274, 276, 278, 280, 282, 284, 286, 287, 289, 291, 293, 295, 297, 373, 375, 377, 379, 381, 383, 385, 387, 544, 545, 547, 549, and 551.

A scaffold protein or scaffold protease can be produced or isolated by any method known in the art including isolation from natural sources, isolation of recombinantly produced proteins in cells, tissues and organisms, and by recombinant methods and by methods including in silico steps, synthetic methods and any methods known to those of skill in the art. Table 14 sets forth exemplary scaffold proteases (see also e.g., merops.sanger.ac.uk). The sequence identifiers (SEQ ID NO) for the nucleotide sequence and encoded amino acid precursor sequence for each of the exemplary candidate proteases is depicted in the Table. The encoded amino acids corresponding to the signal peptide or propeptide sequence to yield a mature protein also are noted in the Table. In addition, amino acids designating the protease domain (i.e. peptidase unit) also are noted, as are the active site residues that make up, for example, the catalytic triad of the respective protease. Since interactions are dynamic, amino acid positions noted are for reference and exemplification. The noted positions reflect a range of loci that vary by 2, 3, 4, 5 or more amino acids. Variations also exist among allelic variants and species variants. Those of skill in the art can identify corresponding sequences by visual comparison or other comparisons including readily available algorithms and software.

TABLE 14

Exemplary Scaffold Proteases

| Merops Code | Name | Gene | Nucl. AC NO: | Synonym | Protein AC NO: | SEQ ID NO: | Signal/ Propep. sequence | Peptidase unit (active site residues) |
|---|---|---|---|---|---|---|---|---|
| S01.010 | granzyme B, human-type | GZMB | M17016 | HLP, CCPI, CGL1, CSPB, SECT, CGL-1, CSP-B, CTLA1, CTSGL1 | P10144 | 3, 4 | 1-18/ 19-20 | 21-247 (64, 108, 203) |
| S01.011 | Testisin | PRSS21 | NM_006799 (v1) NM_144956 (v2) NM_144957 (v3) | ESP-1, TEST1 | NP_006790 NP_659205 NP_659206 | 70, 71 (V1); 72, 73 (V2); 74, 75 (V2) | 1-19/ 20-41 | 42-288 (82, 137, 238) |
| S01.015 | tryptase beta 1 (*Homo sapiens*) (III) | TPSB1 | NM_003294 | TPS1, TPS2, TPSAB1, alpha II | NP_003285 | 76, 77 | 1-18/ 19-30 | 31-274 (74, 121, 224) |
| S01.017 | kallikrein hk5 | KLK5 | NM_012427 | SCTE, KLKL2, KLK-L2 | NP_036559 | 78, 79 | 1-22/ | 67-292 (108, 153, 245) |
| S01.019 | Corin | | NM_006587 | CRN, ATC2, Lrp4, TMPRSS10 | NP_006578 | 80, 81 | | 802-1037 (843, 892, 985) |
| S01.020 | kallikrein 12 | KLK12 | NM_019598 (v1) NM_145894 (v2) NM_145895 (v3) | KLK-L5 | NP_062544 NP_665901 NP_665902 | 82, 83 (V1); 84, 85 (V2); 86, 87 (V3) | 1-17/ | 22-248 (843, 892, 985) |
| S01.021 | DESC1 oritease | | AF064819 | | AAF04328 | 88, 89 | | 191-422 (231, 276, 372) |
| S01.028 | tryptase gamma 1 | TPSG1 | NM_012467 | TMT, trpA, PRSS31 | NP_036599 | 90, 91 | 1-19/ | 38-272 (78, 125, 222) |
| S01.029 | kallikrein hK14 | KLK14 | NM_022046 | KLK-L6 | NP_071329 | 92, 93 | 1-18/ 19-24 | 25-249 (67, 111, 204) |
| S01.033 | hyaluronan-binding serine protease (HGF activator-like protein) | HABP2 | NM_004132 | FSAP, HABP, PHBP, HGFAL | NP_004123 | 94, 95 | 1-23/ | 314-557 (362, 411, 509) |
| S01.034 | transmembrane protease, serine 4 | TMPRSS4 | NM_019894 (v1) NM_183247 (v2) | MT-SP2, TMPRSS3 | NP_063947 NP_899070 | 96, 97 (V1); 98, 99 (V2) | | 205-436 (245, 290, 387) |
| S01.054 | tryptase delta 1 (*Homo sapiens*) | TPSD1 | NM_012217 | MCP7L1, MMCP-7L, MGC95428 | NP_036349 | 100, 101 | 1-18/ 19-30 | 31-235 (74, 121, 224) |
| S01.074 | Marapsin | | NM_031948 | PRSS27, CAPH2 | NP_114154 | 102, 103 | 1-22/ 23-34 | 35-279 (75, 124, 229) |
| S01.075 | Tryptase homologue 2 (*Homo sapiens*) | | BC036846 | PRSS33, EOS | AAN04055 | 104, 105 | | 37-281 (77, 126, 231) |
| S01.076 | Tryptase homologue 3 (*Homo sapiens*) | | Putative Only AC005570 (Cosmid 407D8) | | | 106, 107 | | 67-304 (107, 213, 259) |
| S01.077 | tryptase chromosome 21 (*Homo sapiens*) | | | | | | | |

TABLE 14-continued

Exemplary Scaffold Proteases

| Merops Code | Name | Gene | Nucl. AC NO: | Synonym | Protein AC NO: | SEQ ID NO: | Signal/ Propep. sequence | Peptidase unit (active site residues) |
|---|---|---|---|---|---|---|---|---|
| S01.079 | transmembrane protease, serine 3 | TMPRSS3 | NM_024022 (vA) NM_032401 (vB) NM_032404 (vC) NM_032405 (vD) | DFNB8, DFNB10, ECHOS1, TADG12 | NP_076927 NP_115777 NP_115780 NP_115781 | 108, 109 (VA); 110, 111 (vB); 112, 113 (vC); 114, 115 (vD) | | 217-451 (257, 304, 401) |
| S01.081 | kallikrein hK15 (*Homo sapiens*) | | NM_023006 (v1) NM_138563 (v2) NM_138564 (v3) NM_017509 (v4) | ACO, HSRNASPH | NP_075382 NP_612630 NP_612631 NP_059979 | 116, 117 (v1); 118, 119 (v2); 120, 121 (v3); 122, 123 (v4) | 1-16/ 17-21 | 22-256 (62, 106, 209) |
| S01.085 | Mername-AA031 peptidase (deduced from ESTs by MEROPS) | | BC035384 | FLJ16649, MGC35022, TRYX3, UNQ2540 | AAH35384 | 124, 125 | | 1-241 (56, 101, 195) |
| S01.087 | membrane-type mosaic serine protease | | AB048796 | | BAB39741 | 126, 127 | | 321-556 (361, 409, 506) |
| S01.088 | mername-AA038 peptidase | | Putative Only AL136097 (RP11-62C3 clone) | | CAC12709 | 128 | | 10-142 (50, 101) |
| S01.098 | mername-AA128 peptidase (deduced from ESTs by MEROPS) | | Putative Only BC041609 | | AAH41609 | 129, 130 | | 33-202 (50, 152) |
| S01.127 | cationic trypsin (*Homo sapiens*-type 1) (cationic) | PRSS1 | NM_002769 | TRP1, TRY1, TRY4, TRYP1 | NP_002760 | 131, 132 | 1-15/ 16-23 | 24-246 (63, 107, 200) |
| S01.131 | Neutrophils elastase | ELA2 | NM_001972 | NE, HLE, HNE, PMN-E | NP_001963 | 133, 134 | 1-27/ 28-29 | 30-249 (70, 117, 202) |
| S01.132 | mannan-binding lectin-associated serine protease-3 | | AF284421 | | AAK84071 | 135, 136 | 1-19/ | 449-710 (497, 553, 664) |
| S01.133 | cathepsin G | CTSG | NM_001911 | CG, MGC23078 | NP_001902 | 137, 138 | 1-18/ 19-20 | 21-245 (64, 108, 201) |
| S01.134 | myeloblastin (proteinase 3) | PRTN3 | NM_002777 | MBT, P29, ACPA, AGP7, PR-3, C-ANCA | NP_002768 | 139, 140 | 1-25/ 26-27 | 28-250 (71, 118, 203) |
| S01.135 | granzyme A | GZMA | NM_006144 | HFSP, CTLA3 | NP_006135 | 141, 142 | 1-26/ 27-28 | 29-261 (69, 114, 212) |
| S01.139 | granzyme M | GZMM | NM_005317 | MET1, LMET1 | NP_005308 | 143, 144 | 1-23/ 24-25 | 26-256 (66, 111, 207) |
| S01.140 | chymase (human-type) | CMA1 | NM_001836 | CYH, MCT1 | NP_001827 | 145, 146 | 1-19/ 21-21 | 22-247 (66, 110, 203) |
| S01.143 | tryptase alpha (1) | TPS1 | NM_003294 | TPS1, TPS2, TPSB1, alpha II | NP_003285 | 147, 148 | 1-18/ 19-30 | 31-274 (74, 121, 224) |
| S01.146 | granzyme K | GZMK | NM_002104 | TRYP2 | NP_002095 | 149, 150 | 1-24/ 26-26 | 27-261 (67, 116, 214) |

TABLE 14-continued

Exemplary Scaffold Proteases

| Merops Code | Name | Gene | Nucl. AC NO: | Synonym | Protein AC NO: | SEQ ID NO: | Signal/ Propep. sequence | Peptidase unit (active site residues) |
|---|---|---|---|---|---|---|---|---|
| S01.147 | granzyme H | GZMH | NM_033423 | CCP-X, CGL-2, CSP-C, CTLA1, CTSGL2 | NP_219491 | 151, 152 | 1-18/ 19-20 | 21-246 (64, 108, 202) |
| S01.152 | chymotrypsin B | CTRB1 | M24400 | CTRB, MGC88037 | P17538 | 7, 8 | 1-18 | 34-263 (75, 120, 213) |
| S01.153 | pancreatic elastase | ELA1 | NM_001971 | | NP_001962 | 153, 154 | 1-8/ 9-18 | 19-256 (63, 111, 206) |
| S01.154 | pancreatic endopeptidase E (A) | | NM_005747 | ELA3 | NP_005738 | 155, 156 | 1-15/ 16-28 | 29-270 (73, 123, 217) |
| S01.155 | pancreatic elastase II (IIA) | | M16652 | | AAA52380 | 157, 158 | 1-16/ 7-28 | 29-269 (73, 121, 216) |
| S01.156 | Enteropeptidase | PRSS7 | NM_002772 | ENTK | NP_002763 | 159, 160 | | 785-1019 (825, 876, 971) |
| S01.157 | chymotrypsin C | | NM_007272 | CLCR | NP_009203 | 161, 162 | 1-16/ 17-29 | 30-268 (74, 121, 216) |
| S01.159 | Prostasin | PRSS8 | NM_002773 | | NP_002764 | 163, 164 | 1-29/ 30-32 | 45-288 (85, 134, 238) |
| S01.160 | kallikrein 1 | KLK1 | NM_002257 | hK1, KLKR, Klk6 | NP_002248 | 165, 166 | 1-18/ 19-24 | 25-261 (65, 120, 214) |
| SO1.161 | kallikrein hK2 (*Homo sapiens*) | KLK2 | NM_005551 (v1) NM_001002231 (v2) NM_001002232 (v3) | hK2, KLK2A2, MGC12201 | NP_005542 NP_001002231 NP_001002232 | 167, 168 (v1); 169, 170 (v2); 171, 172 (v3) | 1-18/ 19-24 | 25-260 (65, 120, 213) |
| S01.162 | kallikrein 3 | KLK3 | NM_001648 (v1) NM_001030047 (v3) NM_001030048 (v4) NM_001030049 (v5) NM_001030050 (v6) | APS, PSA, hK3, KLK2A1 | NP_001639 NP_001025218 NP_001025219 NP_001025220 NP_001025221 | 173, 174 (v1); 175, 176 (v3); 177, 178 (v4); 179, 180 (v5); 181, 182 (v6) | 1-17/ 18-24 | 25-260 (65, 120, 213) |
| S01.174 | Mesotrypsin | PRSS3 | NM_002771 | MTG, TRY3, TRY4, PRSS4 | NP_002762 | 183, 184 | 1-24/ | 24-246 (63, 107, 200) |
| S01.205 | pancreatic endopeptidase E form B (B) | ELA3B | NM_007352 | | NP_031378 | 185, 186 | 1-15/ 16-28 | 29-270 (73, 123, 217) |
| S01.206 | pancreatic elastase II form B (*Homos sapiens*) (IIB) | | NM_015849 | MGC97052 | NP_056933 | 187, 188 | 1-16/ 17-28 | 29-269 (73, 121, 216) |
| S01.211 | coagulation factor XIIa | F12 | NM_000505 | HAF | NP_000496 | 189, 190 | 1-19/ | 373-615 (412, 461, 563) |
| S01.212 | plasma kallikrein | KLKB1 | NM_000892 | KLK3 | NP_000883 | 191, 192 | 1-19/ | 391-628 (434, 483, 578) |
| S01.213 | coagulation factor XIa | F11 | NM_000128 (v1) NM_019559 (v2) | FXI | NP_000119 NP_062505 | 193, 194 (v1); 195, 196 (v2) | 1-18/ | 388-625 (431, 480, 575) |
| S01.214 | coagulation factor IXa | F9 | NM_000133 | FIX, PTC, HEMB, GLA domain | NP_000124 | 197, 198 | 1-28/ 29-46 | 227-461 (267, 315, 411) |
| S01.215 | coagulation factor VIIa | F7 | NM_000131 (v1) NM_019616 (v2) | | NP_000122 NP_062562 | 199, 200 (v1); 201, 202 (v2) | 1-20/ 21-60 | 213-454 (253, 302, 404) |
| S01.216 | coagulation factor Xa | F10 | NM_000504 | FX, FXA | NP_000495 | 203, 204 | 1-31/ 32-40 | 235-469 (276, 322, 419) |
| S01.217 | Thrombin | F2 | NM_000506 | PT | NP_000497 | 205, 206 | 1-24/ 25-43 | 364-620 (406, 462, 568) |
| S01.218 | protein C (activated) | PROC | NM_000312 | PROC1, protein C | NP_000303 | 207, 208 | 1-32/ 33-42 | 212-452 (253, 299, 402) |

TABLE 14-continued

Exemplary Scaffold Proteases

| Merops Code | Name | Gene | Nucl. AC NO: | Synonym | Protein AC NO: | SEQ ID NO: | Signal/ Propep. sequence | Peptidase unit (active site residues) |
|---|---|---|---|---|---|---|---|---|
| S01.223 | Acrosin | ACR | NM_001097 | | NP_001088 | 209, 210 | 1-19 | 43-292 (88, 142, 240) |
| S01.224 | Hepsin | HPN | NM_182983 (v1) NM_002151 (v2) | TMPRSS1 | NP_892028 NP_002142 | 211, 212 (v1); 213, 214 (v2) | | 163-407 (203, 257, 353) |
| S01.228 | hepatocyte growth factor activator | HGFAC | NM_001528 | HGFA | NP_001519 | 215, 216 | 1-35/ 36-372 | 408-648 (447, 497, 598) |
| S01.231 | u-plasminogen activator (uPA) | PLAU | NM_002658 | ATF, UPA, URK, u-PA | NP_002649 | 217, 218 | 1-20/ | 179-426 (224, 275, 376) |
| S01.232 | t-plasminogen activator (tPA) | PLAT | NM_000930 (v1) NM_000931 (v2) NM_033011 (v3) | TPA, T-PA, DKFZp686 I03148 | NP_000921 NP_000922 NP_127509 | 219, 220 (v1); 221, 222 (V2), 223, 224 (V3) | 1-23/ 24-32 and 33-35 | 311-562 (357, 406, 513) |
| S01.233 | Plasmin | PLG | NM_000301 | DKFZp779 M0222 | NP_000292 | 225, 226 | 1-19/ 20-97 | 581-810 (622, 665, 760) |
| S01.236 | Neurosin | KLK6 | NM_002774 (vA) NM_001012964 (vB) NM_001012965 (vC) NM_001012966 (vD) | hK6, Bssp, Klk7, SP59, ZYME, PRSS9, PRSS18, MGC9355, NEUROSIN | NP_002765 NP_001012982 NP_001012983 NP_001012984 | 227, 228 (vA); 229, 230 (vB); 231, 232 (vC); 233, 234 (vD) | 1-16/ 17-21 | 22-244 (62, 106, 197) |
| S01.237 | Neurotrypsin | PRSS12 | NM_003619 | BSSP3, BSSP-3, MGC12722, MOTOPSIN | NP_003610 | 235, 236 | 1-20/ | 631-875 (676, 726, 825) |
| S01.242 | tryptase beta 2 (Homo sapiens) (I) | TPSB1 | NM_024164 | TPS2, TPSB1, tryptaseC | NP_077078 | 237, 238 | 1-30/ | 31-268 |
| S01.244 | Neuropsin | KLK8 | NM_007196 (v1) NM_144505 (v2) NM_144506 (v3) NM_144507 (v4) | NP, HNP, NRPN, PRSS19, TADG14 | NP_009127 NP_653088 NP_653089 NP_653090 | 239, 240 (v1); 241, 242 (v2), 243, 244 (v3); 245, 246 (v4) | 1-28/ 29-32 | 33-258 (73, 120, 212) |
| S01.246 | kallikrein hK10 (Homo sapiens) | KLK10 | NM_002776 (v1) NM_145888 (v2) | NES1, PRSSL1 | NP_002767 NP_665895 | 247, 248 (v1); 249, 250 (v2) | 1-30/ | 35-276 (86, 137, 229) |
| S01.247 | Epitheliasin | TMPRSS2 | NM_005656 | PRSS10 | NP_005647 | 251, 252 | | 256-491 (296, 345, 441) |
| S01.251 | Prostase | KLK4 | NM_004917 | ARM1, EMSP, PSTS, EMSP1, KLK-L1, PRSS17 | NP_004908 | 253, 254 | 1-26/ 27-30 | 31-254 (71, 116, 207) |
| S01.252 | Brain serine proteinase 2 | | NM_022119 | BSSP-4, MGC9599, SP001LA, hBSSP-4 | NP_071402 | 255, 256 | 1-32 | 50-292 (90, 141, 242) |
| S01.256 | Chymopasin | CTRL | NM_001907 | CTRL1, MGC70821 | NP_001898 | 257, 258 | 1-18/ 19-33 | 34-264 (75, 121, 214) |
| S01.257 | kallikrein 11 | KLK11 | NM_006853 (v1) NM_144947 (v2) | TLSP, PRSS20, MGC33060 | NP_006844 NP_659196 | 259, 260 (v1); 261, 262 (v2) | 1-50/ 51-53 | 22-250 (62, 110, 203) |
| S01.258 | anionic trypsin (Homo sapiens) (II) | PRSS2 | NM_002770 | TRY2, TRY8, TRYP2 | NP_002761 | 263, 264 | 1-15/ 16-23 | 24-246 (63, 107, 200) |

TABLE 14-continued

Exemplary Scaffold Proteases

| Merops Code | Name | Gene | Nucl. AC NO: | Synonym | Protein AC NO: | SEQ ID NO: | Signal/ Propep. sequence | Peptidase unit (active site residues) |
|---|---|---|---|---|---|---|---|---|
| S01.291 | LOC144757 peptidase (Homo sapiens) | | Putative BC048112 | MGC57341 | AAH48112 | 265, 266 | | 78-319 (122, 171, 268) |
| S01.292 | Mername-AA169 peptidase | | BN000133 | | CAD67985 | 267, 268 | 1-19 | 175-406 (215, 260, 356) |
| S01.294 | Mername-AA171 peptidase | | Putative No DNA | | | 269 | | |
| S01.298 | Mername-AA174 peptidase | | Putative no DNA seq | TRY6 | AAC80208 | 270 | | 24-246 (63, 107, 200) |
| S01.299 | Mername-AA175 peptidase | | NM_198464 | | NP_940866 | 271, 272 | | 68-302 (108, 156, 250) |
| S01.300 | stratum corneum chymotryptic enzyme | KLK7 | NM_005046 (v1) NM_139277 (v2) | SCCE, PRSS6 | NP_005037 NP_644806 | 273, 274 (v1); 275, 276 (v2) | 1-22/ 23-29 | 30-250 (70, 112, 205) |
| S01.301 | trypsin-like enzyme, respiratory (Homo sapiens) | | NM_004262 | HAT | NP_004253 | 277, 278 | | 187-471 (227, 272, 368) |
| S01.302 | Matripase | ST14 | AF118224 | HAI, MTSP1, SNC19, MT-SP1, MTSP-1, PRSS14, TADG-15 | AAD42765 | 1, 2 | | 615-855 (656, 711, 805) |
| S01.306 | kallikrein hK13 | KLK13 | NM_015596 | KLKL4, KLK-L4, DKFZP586J1923 | NP_056411 | 279, 280 | 1-16/ | 36-263 (76, 124, 218) |
| S01.307 | kallikrein hK9 (human numbering) | KLK9 | NM_012315 | KLKL3, KLK-L3 | NP_036447 | 281, 282 | 1-15/ | 23-250 (63, 111, 204) |
| S01.308 | Mername-AA035 peptidase | | NM_153609 | | NP_705837 | 283, 284 | | 49-283 (89, 140, 234) |
| S01.309 | umbilical vein proteinase | | NM_007173 | SIG13, SPUVE, ZSIG13, MGC5107 | NP_009104 | 285, 286 | 1-23/ | 95-383 (175, 246, 316) |
| S01.311 | LCLP proteinase (LCLP (N-terminus)) | | Peptide fragment No DNA | | P34168 | 287 | | 1-26 (0) |
| S01.313 | Spinesin | TMPRSS5 | NM_030770 | | NP_110397 | 288, 289 | | 218-455 (258, 308, 405) |
| S01.318 | Mername-AA178 peptidase | MPN2 | NM_183062 | | NP_898885 | 290, 291 | 1-33/ | 53-288 (93, 143, 238) |
| S01.320 | Mername-AA180 peptidase | OVTN | BN000120 | | CAD66452 | 292, 293 | 1-23/ | 52-301 (92, 142, 240) |
| S01.322 | Mername-AA182 peptidase | OVCH1 | BN000128 | | CAD67579 | 294, 295 | 1-17/ | 8-298 (87, 139, 237) |
| S01.414 | Mername-AA122 peptidase (deduced from ESTs by MEROPS) | | Putative AK075142 | | BAC11431 | 296, 297 | | 1-177 (12, 64, 168) |
| C01.032 | Cathepsin L | CTSL | Y14734 | | P07711 | 372, 373 | 1-17/ 18-113 | 113-333 (132, 138, 276, 300) |
| C01.009 | Cathepsin V | CTSL2 | U13665 | | O60911 | 374, 375 | 1-17/ 18-113 | 114-334 (132, 138, 277, 301) |

TABLE 14-continued

Exemplary Scaffold Proteases

| Merops Code | Name | Gene | Nucl. AC NO: | Synonym | Protein AC NO: | SEQ ID NO: | Signal/ Propep. sequence | Peptidase unit (active site residues) |
|---|---|---|---|---|---|---|---|---|
| C01.036 | Cathepsin K | CTSK | S93414 | | P43235 | 376, 377 | 1-15/ 16-114 | 115-329 (133, 139, 276, 296) |
| C01.034 | Cathepsin S | CTSS | AJ007331 | | P25774 | 378, 379 | 1-16/ 17-114 | 115-331 (133, 139, 278, 298) |
| C01.018 | Cathepsin F | CTSF | M14221 | | Q9UBX1 | 380, 381 | 1-19/ 20-270 | 271-484 (289, 295, 431, 451) |
| C01.060 | Cathepsin B | CTSB | M15203 | | P07858 | 382, 383 | 1-17/ 18-79 | 80-331 (102, 108, 278, 298) |
| C01.001 | Papain | | M84342 | | P00784 | 384, 385 | 1-18/ 19-133 | 135-342 (158, 292, 308) |
| C01.075 | Cruzain (Cruzapain) | | Y14734 | | P25779 | 386, 387 | 123-467/ | 124-334 (147, 284, 304, |
| A02.001 | HIV-1 protease | | | HIV-1 retropepsin; HIV-1 PR | P03366 (aa 500-598) | 544 | | |
| A02.015 | RSV protease | | | avian myeloblastosis virus retropepsin; avian sarcoma virus endopeptidase; retropepsin | P03322 (aa 578-701) | 545 | | |
| M10.005 | Matrix metallo-protease-3 | MMP3 | X05232 | collagenase activating protein; MMP-3; stromelysin 1; transin | CAA28859.1 | 546, 547 | | |
| M12.209 | ADAM9 endopeptidase | ADAM9 | NM_003816 | MDC9 | NP_003807 | 548, 549 | | |
| M12.210 | ADAM10 endopeptidase | ADAM10 | NM_003816 | MADM | NP_001101 | 550, 551 | | |

In some embodiments, the protease scaffold is a granzyme B, granzyme A, granzyme M, cathepsin G, MT-SP1, neutrophil elastase, chymase, alpha-tryptase, beta-tryptase I or II, chymotrypsin, collagenase, factor XII, factor XI, factor CII, factor X, thrombin, protein C, u-plasminogen activator (u-PA), t-plasminogen activator (t-PA), plasmin, plasma kallikrein, chymotrypsin, trypsin, a cathepsin, papain, cruzain, a metalloprotease and allelic variations, isoforms and catalytically active portions thereof. Such proteases can be used in the methods provided herein to target one or more target substrates of a complement pathway. Such proteases also can be modified to have altered specificity or selectivity for any one or more protein components of the complement pathway and/or to modulate an activity of a complement protein or pathway. The proteases or modified proteases can be used in the methods provided herein to modulate complement activation, and hence can be used as therapeutics to treat any complement-mediated disease or disorder. In some embodiments, the protease scaffold is MT-SP1. Modifications of amino acids in MT-SP1 can be made to alter the specificity and/or selectivity for a complement protein target substrate.

1. Modified Scaffold Proteases

Virtually every aspect of a protease can be re-engineered, including the enzyme substrate sequence specificity, thermostability, pH profile, catalytic efficiency, oxidative stability, and catalytic function. Provided herein are modified proteases that exhibit increased specificity and/or selectivity to any one or more complement proteins compared to a scaffold protease. Proteases can be modified using any method known in the art for modification of proteins. Such methods include site-directed and random mutagenesis. Assays such as the assays for biological function of complement activation provided herein and known in the art can be used to assess the biological function of a modified protease to determine if the modified protease targets a substrate for cleavage and inactivation. Exemplary methods to identify a protease and the modified proteases are provided herein.

For example, any of a variety of general approaches for protein-directed evolution based on mutagenesis can be employed. Any of these, alone or in combination can be used to modify a polypeptide such as a protease to achieve altered specificity and/or selectivity to a target substrate. Such methods include random mutagenesis, where the amino acids in the starting protein sequence are replaced by all (or a group) of the 20 amino acids either in single or multiple replacements at different amino acid positions on the same molecule, at the same time. Another method, restricted random mutagenesis, introduces either all or some of the 20 amino acids or DNA-biased residues. The bias is based on the sequence of the DNA and not on that of the protein in a stochastic or semi-stochastic manner, respectively, within restricted or predefined regions of the protein known in advance to be involved in the biological activity being "evolved." Exemplary methods for generating modified proteases are described in related U.S. application Ser. No. 10/677,977, herein incorporated by reference in its entirety. Additionally, any method known in the art can be used to modify or alter a protease polypeptide sequence.

Among the modified polypeptides provided herein are proteases with one or more modifications compared to a scaffold protease. Modified protease polypeptides include those with 1, 2, 3, 4, 5, 6, 7, 8, 9, 10, 11, 12, 13, 14, 15, 16, 17, 18, 19, 20 or more modified positions. Modified proteases provided herein retain their protease ability but display altered (i.e. enhanced) specificity towards any one or more complement protein target substrates compared to a natural substrate of the protease and/or display an altered selectivity for any one or more proteins of the complement system. A modified protease specific for any one or more of the complement proteins can be generated rationally or empirically by: (a) rationally targeting sites that complement a cleavage sequence of a target complement substrate recognized by a known protease, such as for example, complement Factor I or, (b) empirically testing a library of modified proteases in functional assays for inactivation of the complement cascade.

a. Rational Modification

Methods are provided to rationally modify a protease to increase the specificity and/or selectivity to a target substrate, such as to any one or more complement proteins. In such a method, a cleavage sequence of the target substrate is known. Cleavage sites within target proteins are identified by the following criteria: 1) they are located on the exposed surface of the protein; 2) they are located in regions that are devoid of secondary structure (i.e. not in β sheets or helices), as determined by atomic structure or structure prediction algorithms (these regions tend to be loops on the surface of proteins or stalk on cell surface receptors); 3) they are located at sites that are likely to inactivate the protein, based on its known function. Cleavage sequences are e.g., four residues in length to match the extended substrate specificity of many proteases, but can be longer or shorter.

Factor I is a serine protease that functions as a natural regulator of complement activation by cleaving C3b and C4b. Factor I cleaves and inactivates C3b and C4b after activation by the convertase on C3 and C4, respectively, and release of C3a and C4a. The peptide cleavage sequences recognized by Factor I include LPSR (SEQ ID NO: 388) and SLLR (SEQ ID NO: 389) in C3 and HRGR (SEQ ID NO: 390) in C4 (see e.g., Davis et al., (1982) *Biochemistry* 21:5745); Harrison et al., (1980) *Mol. Immunology.* 17:9; Kai et al., (1980) *J Immunol.* 125:2409). Provided herein are methods to rationally design the specificity binding pocket of a protease to recognize and specifically cleave Factor I substrates, including C3 and C4 as well as iC3, C3b, iC4, and C4b, thereby inhibiting complement activation. Products that cleave the Factor I substrates are provided.

As an example, modified proteases with altered specificity for a Factor I target sequence are generated by a structure-based design approach. Each protease has a series of amino acids that line the active site pocket and make direct contact with a substrate. The amino acids that line the active site pocket of a protease are designated S1-S4 and the respective substrate contact sites are designated P1-P4. The identity of the amino acids that contain the S1-S4 pocket of the active site determines the substrate specificity of that particular pocket. Amino acids that form the substrate binding pocket of exemplary proteases are described herein. Generally, the substrate specificity of a protease is known or can be determined, such as, for example by molecular modeling based on three-dimensional structures of the complex of a protease and substrate (see for example, Wang et al., (2001) *Biochemistry* 40(34):10038; Hopfner et al., *Structure Fold Des.* 1999 7(8):989; Friedrich et al., (2002) *J Biol Chem* 277(3):2160; Waugh et al., (2000) *Nat Struct Biol.* 7(9):762). In one example, the amino acids that participate in the S1-S4 substrate binding pocket of MT-SP1 are as follows (based on chymotrypsin numbering): 189, 190, 191, 192, 216 and 226 (S1); 57, 58, 59, 60, 61, 62, 63, 64, 99 (S2); 146, 192, 217, 218 (S3); 96, 97, 98, 99, 100, 168, 169, 170, 170A, 171, 172, 173, 174, 175, 176, 178, 179, 180, 215, 217, 224 (S4). In another example, the amino acids in a papain family protease that contribute to P2 specificity (standard papain numbering) include amino acids 66-68, 133, 157, 160, and/or 215. Modifying any one or more of the amino acids that make up the S1-S4 active site of a protease would alter the substrate specificity of that protease. For example, a mutation at position 99 in the S2 pocket of a serine protease, such as for example an MT-SP1 protease, to a smaller amino acid confers a preference for larger hydrophobic residues in the P2 substrate position. Using this process of selective mutagenesis, proteases with substrate specificities to a Factor I cleavage sequence can be generated.

In one embodiment, point mutations can be made in the amino acids that contribute to the specificity binding pocket of a protease, particularly in any one or more S1-S4 amino acid residues that contribute to P1-P4 substrate specificity. Generally, the amino acid residues that contribute to the P1-P4 specificity of a protease can be rationally replaced so that the target substrate cleavage site recognized by Factor I is produced. In one example, a protease can be modified to recognize the target cleavage sequence LPSR/KI (SEQ ID NO: 724) where any one or more amino acids in the S4 position can be modified to recognize a leucine at the P4 position, any one or more amino acids in the S3 position can be modified to recognize a proline at the P3 position, any one or more amino acids in the S2 position can be modified to recognize a serine at the P2 position, and any one or more amino acids in the S1 position can be modified to recognize an arginine at the P1 position. In another example, a protease can be modified to recognize the target cleavage sequence SLLR/SE (SEQ ID NO: 725) where any one or more amino acids in the S4 position can be modified to recognize a serine at the P4 position, any one or more amino acids in the S3 position can be modified to recognize a leucine at the P3 position, any one or more amino acids in the S2 position can be modified to recognize a leucine at the P2 position, and any one or more amino acids in the S1 position can be modified to recognize an arginine at the P1 position. In an additional example, a protease can be modified to recognize the target cleavage sequence HRGR/TL (SEQ ID NO: 726) where any one or more amino acids in the S4 position can be modified to recognize a histidine at the P4 position, any one or more amino acids in the S3 position can be modified to recognize an arginine at the P3 position, any one or more amino acids in the S2 position can be modified to recognize a glycine at the P2 position, and any one or more amino acids in the S1 position can be modified to recognize an arginine at the P1 position. In some cases, mutations in serine proteases have shown that each of the sub-sites that form the active site (S1-S4) function independently of one another, such that modification of specificity at one sub-site has little influence on specificity at adjacent sub-sites. Thus, engineering substrate specificity and/or selectivity throughout the extended binding site can be accomplished in a step-wise manner.

For example, a protease with low specificity for a residue at a particular binding site or for a particular sequence is altered in its specificity by making point mutations in the substrate sequence binding pocket. In some cases, the resulting mutant has a greater than 1.5, 2, 5, 8, 10-fold or greater increase in specificity at a site for a particular sequence than does wildtype. In another embodiment, the resulting mutant has a greater than 100-fold increase in specificity at a site for a particular sequence than does wildtype. In another embodiment, the resulting mutant has an over 1000-fold increase in specificity at a site or for a particular sequence than does a wildtype.

In one exemplary embodiment, wildtype MT-SP1 protease having a P1-P4 preference for a target cleavage sequence of Arg/Lys at P4, basic residues or Gln at P3, small residues at P2, and Arg or Lys at P1 can be modified so that the Factor I cleavage sequence of LPSR (SEQ ID NO: 388), SLLR (SEQ ID NO: 389), or HRGR (SEQ ID NO: 390) is recognized by an MT-SP1 protease (see Table 15). In such an example, the S1 position of the modified MT-SP1 is unchanged since the arginine residue at the P1 site is conserved between the target substrate cleavage site of MT-SP1 and the Factor I cleavage sites. Amino acid residues in any one of more of the S2-S4 sub-sites of MT-SP1 can be modified alone or in combination to increase the specificity and/or selectivity for a Factor I cleavage sequence. For example, to modify an MT-SP1 set forth in SEQ ID NO:2 or 10 to have increased specificity and/or selectivity for a SLLR Factor I cleavage sequence (SEQ ID NO: 389) in C3b, modifications in the S4 position of MT-SP1 to recognize a serine in the P4 position of the substrate can include amino acid modifications Q174H, D217Q, D217N, D217H, D96A, D96V, D96F, D96S, and/or D96T, based on chymotrypsin numbering; modification in the S3 position of MT-SP1 to recognize a leucine in the P3 position of the substrate can include amino acid modifications Q192L, Q192I, Q192F, and/or Y146F, based on chymotrypsin numbering; and/or modifications in the S2 position of MT-SP1 to recognize a leucine in the P2 position of the substrate can include amino acid modifications F99A, F99V, F99S, and/or F99G, based on chymotrypsin numbering. In another example, to modify an MT-SP1 set forth in SEQ ID NO: 2 or 10 to have increased specificity and/or selectivity for a LPSR Factor I cleavage sequence (SEQ ID NO: 388) in C3b, modifications in the S4 position of MT-SP1 to recognize a leucine in the P4 position of the substrate can include amino acid modifications W215F, W215Y, Q174F, Q174V, Q174L, Q174Y, and/or M180E, based on chymotrypsin numbering; modifications in the S3 position of MT-SP1 to recognize a proline in the P3 position of the substrate can include amino acid modifications Q192K, Q192R, Q192R, based on chymotrypsin numbering; and/or modifications in the S2 position of MT-SP1 to recognize a serine in the P2 position of the substrate can include amino acid modifications F99Y, based on chymotrypsin numbering. In an additional example, to modify an MT-SP1 set forth in SEQ ID NO: 2 or 10 to have increased specificity and/or selectivity for a HRGR Factor I cleavage sequence (SEQ ID NO: 390) in C4b, modifications in the S4 position of MT-SP1 to recognize a histidine in the P4 position of the substrate can include amino acid modifications W215F, W215Y, Q174A, Q174V, Q174F, Q174R, and/or Q174K, based on chymotrypsin numbering; modifications in the S3 position of MT-SP1 to recognize an arginine in the P3 position of the substrate can include amino acid modifications D217A, D217V, and/or Q192E, based on chymotrypsin numbering; and/or modification is the S2 position of MT-SP1 to recognize a glycine in the P2 position of the substrate can include amino acid modifications F99W, F99Y, and/or F99D, based on chymotrypsin numbering. Exemplary modifications of an MT-SP1 protease scaffold are summarized in Table 15. Combinations of modifications of the noted positions also are contemplated. Any method known in the art to effect mutation of any one or more amino acids in a target protein can be employed. Methods include standard site-directed mutagenesis (using e.g., a kit, such as kit such as QuikChange available from Stratagene) of encoding nucleic acid molecules, or by solid phase polypeptide synthesis methods.

TABLE 15

Exemplary modifications in MT-SP1 to alter target specificity to Factor I cleavage sequence

| | S4 | | | | S3 | | S2 |
|---|---|---|---|---|---|---|---|
| | D96 | Q174 | M180 | W215 | D217 | Y146 | Q192 | F99 |
| SLLR | A, V, F, S, T | H | | | Q, N, H | F | L, I, F | A, V, S, G |
| LPSR | | F, V, L, Y | E | F, Y | | | K, R, Y | Y |
| HRGR | | A, V, F, R, K | | F, Y | A, V | | E | W, Y | i. Synthesis of Positional Scanning Libraries and Screening Using Fluorescence

A protease, modified at any one or more of the S1-S4 subsites can be verified for P1-P4 substrate specificity at any given sub-site using a positional scanning synthetic combinatorial library (PS-SCL) containing a combinatorial fluorogenic substrate library (Harris et al., (2000) *PNAS* 97:7754; US 2004/0175777; US 2004/0146938). A PS-SCL strategy allows for the rapid and facile determination of proteolytic substrate specificity at any one or more S1-S4 active site sub-sites. A PS-SCL strategy involves the use of libraries of peptides whereby one position in the library is held constant, while the remaining positions are composed of all combinations of amino acids used to prepare the library. The use of a combinatorial fluorogenic peptide substrate library, such as for example a 7-amino-4-methylcoumarin (AMC) fluorogenic peptide substrate or a 7-amino-4-carbamoylmethylcoumarin (ACC) fluorogenic peptide substrate, can be used to assay for the activity of a modified protease whereby a fluorogenic moiety is released from a peptide substrate upon action of the protease. Those of skill in the art will appreciate that these methods provide a wide variety of alternative library formats. In one example, a protease can be profiled with a P1-diverse library. A P1-diverse tetrapeptide library contains ACC- or AMC-fluorogenic tetrapeptides whereby the P1 position is systematically held constant while the P2, P3, and P4 positions contain an equimolar mixture of any one or more of the 20 amino acids. An ACC P1-fixed library allows for the verification of the P4, P3, and P2 specificities of any one of the modified proteases. In another example, fixing the P2-position as a large hydrophobic amino acid can circumvent preferential internal cleavage by papain-fold proteases and lead to proper register of the substrate sequence. Determination and consideration of particular limitations relevant to any particular enzyme or method of substrate sequence specificity determination are within the ability of those of skill in the art.

Those of skill in the art will recognize that many methods exist to prepare the peptides. In an exemplary embodiment, the substrate library is screened by attaching a fluorogenically tagged substrate to a solid support. In one example, the fluorogenic leaving group from the substrate peptide is synthesized by condensing an N-Fmoc coumarin derivative, to acid-labile Rink linker to provide ACC resin (Backes et al., (2000) *Nat. Biotechnol.* 18:187). Fmoc-removal produces a free amine. Natural, unnatural and modified amino acids can be coupled to the amine, which can be elaborated by the coupling of additional amino acids. In an alternative embodiment, the fluorogenic leaving group can be 7-amino-4-methylcoumarin (AMC) (Harris et al., (2000) *PNAS* 97:7754). After the synthesis of the peptide is complete, the peptide-fluorogenic moiety conjugate can be cleaved from the solid support, or alternatively, the conjugate can remain tethered to the solid support.

Typically, a method of preparing a fluorogenic peptide or a material including a fluorogenic peptide includes: (a) providing a first conjugate containing a fluorogenic moiety covalently bonded to a solid support; (b) contacting the first conjugate with a first protected amino acid moiety and an activating agent, thereby forming a peptide bond between a carboxyl group and the amine nitrogen of the first conjugate; (c) deprotecting, thereby forming a second conjugate having a reactive amine moiety; (d) contacting the second conjugate with a second protected amino acid and an activating agent, thereby forming a peptide bond between a carboxyl group and the reactive amine moiety; and (e) deprotecting, thereby forming a third conjugate having a reactive amine moiety. In an exemplary embodiment, the method further includes: (f) contacting the third conjugate with a third protected amino acid and an activating agent, thereby forming a peptide bond between a carboxyl group and the reactive amine moiety; and (e) deprotecting, thereby forming a fourth conjugate having a reactive amine moiety.

For amino acids that are difficult to couple (e.g., Ile, Val, etc.), free, unreacted amine can remain on the support and complicate subsequent synthesis and assay operations. A specialized capping step employing the 3-nitrotriazole active ester of acetic acid in DMF efficiently acylates the remaining aniline. The resulting acetic-acid capped coumarin that can be present in unpurified substrate sequence solution is generally not a protease substrate sequence.

Solid phase peptide synthesis in which the C-terminal amino acid of the sequence is attached to an insoluble support followed by sequential addition of the remaining amino acids in the sequence is an exemplary method for preparing the peptide backbone of the polypeptides provided herein. Techniques for solid phase synthesis are described by Narany and Merrifield, Solid-Phase Peptide Synthesis; pp. 3-284 in *The Peptides: Analysis, Synthesis, Biology*. Vol. 2; *Special Methods in Peptide Synthesis*, Part A., Gross and Meienhofer, eds. Academic press, N.Y., (1980); and Stewart et al., (1984) *Solid Phase Peptide Synthesis*, $2^{nd}$ etd. Pierce Chem. Co., Rockford, Ill. Solid phase synthesis is most easily accomplished with commercially available peptide synthesizers utilizing Fmoc or t-BOC chemistry.

For example, peptide synthesis can be performed using well known Fmoc synthesis chemistry. For example, the side chains of Asp, Ser, Thr, and Tyr are protected using t-butyl and the side chain of Cys residue using S-trityl and S-t-butylthio, and Lys residues are protected using t-Boc, Fmoc and 4-methyltrityl. Appropriately protected amino acid reagents are commercially available or can be prepared using art-recognized methods. The use of multiple protecting groups allows selective deblocking and coupling of a fluorophore to any particular desired side chain. Thus, for example, t-Boc deprotection is accomplished using TFA in dichloromethane. Fmoc deprotection is accomplished using, for example, 20% (v/v) piperidine in DMF or N-methylpyrolidone, and 4-methyltrityl deprotection is accomplished using, for example, 1 to 5% (v/v) TFA in water or 1% TFA and 5% triisopropylsilane in DCM. A-t-butylthio deprotection is accomplished using, for example, aqueous mercaptoethanol (10%). Removal of t-buyl, t-boc, and S-trityl groups is accomplished using, for example TFA:phenol: water:thioaniso:ethanedithio (85:5:5:2.5:2.5), or TFA:phenol:water (95:5:5).

Diversity at any particular position or combination of positions can be introduced using a mixture of at least two, six, 12, 20 or more amino acids to grow the peptide chain. The mixtures of amino acids can include any useful amount of a particular amino acid in combination with any useful amount of one or more different amino acids. In one embodiment, the mixture is an isokinetic mixture of amino acids (a mixture in appropriate ratios to allow for equal molar reactivity of all components).

Modified proteases can be combined to acquire the specificity of multiple modified proteases. A mutation at one residue of a scaffold, which produces specificity at one site, is combined in the same protease with another mutation at another site on the scaffold to make a combined specificity protease. Any number of mutations at discrete sites on the same scaffold can be used to create a combined specificity protease.

Modified proteases, such as for example a modified MT-SP1 protease, that match the desired specificity profile, can then be assayed using individual fluorogenic peptide substrates corresponding to the desired cleavage sequence. A method of assaying for a modified protease that can cleave any one or more of the Factor I cleavage sequences includes: (a) contacting a peptide fluorogenic sample (containing a Factor I cleavage sequence) with a protease, in such a manner whereby a fluorogenic moiety is released from a peptide substrate sequence upon action of the protease, thereby producing a fluorescent moiety; and (b) observing whether the sample undergoes a detectable change in fluorescence, the detectable change being an indication of the presence of the enzymatically active protease in the sample. In such an example an ACC- or AMC-tetrapeptide such as Ac-SLLR-AMC or Ac-HRGR-AMC can be made and incubated with a modified protease and activity of the protease can be assessed by assaying for release of the fluorogenic moiety.

Assaying for a protease in a solution simply requires adding a quantity of the stock solution of a protease to a fluorogenic protease indicator peptide and measuring the subsequent increase in fluorescence or decrease in excitation band in the absorption spectrum. The solution and the fluorogenic indicator also can be combined and assayed in a "digestion buffer" that optimizes activity of the protease. Buffers suitable for assaying protease activity are well known to those of skill in the art. In general, a buffer is selected with a pH which corresponds to the pH optimum of the particular protease. For example, a buffer particularly suitable for assaying elastase activity contains 50 mM sodium phosphate, 1 mM EDTA at pH 8.9. The measurement is most easily made in a fluorometer, an instrument that provides an "excitation" light source for the fluorophore and then measures the light subsequently emitted at a particular wavelength. Comparison with a control indicator solution lacking the protease provides a measure of the protease activity. The activity level can be precisely quantified by generating a standard curve for the protease/indicator combination in which the rate of change in fluorescence produced by protease solutions of known activity is determined.

While detection of fluorogenic compounds can be accomplished using a fluorometer, detection also can be accomplished by a variety of other methods well known to those of skill in the art. Thus, for example, when the fluorophores emit in the visible wavelengths, detection can be simply by visual inspection of fluorescence in response to excitation by a light source. Detection also can be by means of an image analysis system utilizing a video camera interfaced to a digitizer or other image acquisition system. Detection also can be by visualization through a filter, as under a fluorescence microscope. The microscope can provide a signal that is simply visualized by the operator. Alternatively, the signal can be recorded on photographic film or using a video analysis system. The signal also can simply be quantified in real time using either an image analysis system or a photometer.

Thus, for example, a basic assay for protease activity of a sample involves suspending or dissolving the sample in a buffer (at the pH optima of the particular protease being assayed), adding to the buffer a fluorogenic protease peptide indicator, and monitoring the resulting change in fluorescence using a spectrofluorometer as shown in e.g., Harris et al., (1998) *J Biol Chem* 273:27364. The spectrofluorometer is set to excite the fluorophore at the excitation wavelength of the fluorophore. The fluorogenic protease indicator is a substrate sequence of a protease that changes in fluorescence due to a protease cleaving the indicator.

Modified proteases also are assayed to ascertain that they will cleave the desired sequence when presented in the context of the full-length protein. The target substrate proteins containing Factor I cleavage sites are in the C3 and C4 sequences, specifically in C3b and C4b which are generated from C3 and C4, respectively, following convertase activation. Factor I also cleaves iC3 and iC4 which are altered species forms of C3 and C4. Methods to assess cleavage of a target protein are described herein and/or are well known in the art. In one example, a purified complement protein, C3b, C4b, iC3, or iC4, can be incubated in the presence or absence of a modified protease and the cleavage event can be monitored by SDS-PAGE followed by Coomassie Brilliant Blue staining for protein and analysis of cleavage products using densitometry. The activity of the target protein also is assayed, such as, for example in a hemolysis assay, using methods described herein or that are well known in the art, to verify that its function has been destroyed by the cleavage event.

b. Empirical Modification

A library of modified proteases can be generated by mutating any one or more amino acid residues of a protease using any method commonly known in the art (see also published U.S. Appln. No. 2004/0146938). The library of modified proteases can be tested in functional assays of complement activation to determine if they are "Hits" for inhibiting complement activation. The target complement substrate of the modified protease can be identified, and the peptide cleavage sequence can be determined.

In one example, any one or more amino acids of a protease are mutated using any standard site-directed mutagenesis kit such as for example QuikChange (Stratagene). In another example, any one or more amino acids of a protease are mutated by saturation mutagenesis of active site residues. In this example, residues that form the S1-S4 pocket of a protease (where the protease is in contact with the P1-P4 residues of the peptide substrate) and/or that have been shown to be important determinants of specificity are mutated to every possible amino acid, either alone or in combination. In some cases, there is little (if any) interaction between the S1-S4 pockets of the active site, such that each pocket appears to recognize and bind the corresponding residue on the peptide substrate sequence independent of the other pockets. Thus, the specificity determinants generally can be changed in one pocket without affecting the specificity of the other pockets. In one exemplary embodiment, a saturation mutagenesis technique is used in which the residue(s) lining the pocket are mutated to each of the 20 possible amino acids (see for example the Kunkle method, Current Protocols in Molecular Biology, John Wiley and Sons, Inc., Media Pa.). In such a technique, a mutagenic oligonucleotide primer is synthesized which contains either NNS or NNK-randomization at the desired codon. The primer is annealed to the single stranded DNA template and DNA polymerase is added to synthesize the complementary strand of the template. After ligation, the double stranded DNA template is transformed into *E. coli* for amplification.

Amino acids that form the extended substrate binding pocket of exemplary proteases are described herein. Generally, the substrate specificity of a protease is known such as for example by molecular modeling based on three-dimensional structures of the complex of a protease and substrate (see for example, Wang et al., (2001) *Biochemistry* 40(34): 10038; Hopiher et al., *Structure Fold Des.* 1999 7(8):989; Friedrich et al., (2002) *J Biol Chem* 277(3):2160; Waugh et al., (2000) *Nat Struct Biol.* 7(9):762). In one example, mutations of MT-SP1 can be in any one or more residues (based on chymotrypsin numbering) that contribute to substrate specificity including 195, 102, 57 (the catalytic triad); 189, 190, 191, 192, 216 and 226 (S1); 57, 58, 59, 60, 61, 62, 63, 64, 99 (S2); 146, 192, 217, 218 (S3); 96, 97, 98, 99, 100, 168, 169, 170, 170A, 171, 172, 173, 174, 175, 176, 178, 179, 180, 215, 217, 224 (S4). In another example, mutation of amino acid residues in a papain family protease can be in any one or more residues that affect P2 specificity (standard papain numbering) including 66-68, 133, 157, 160, and/or 215. In addition, residues that do not directly contact the protease substrate, but do affect the position and/or conformation of contact residues (such as for example those listed above) also can be mutated to alter the specificity of a protease scaffold.

To identify those modified proteases that target any one or more of the complement proteins, a library of modified proteases generated from a protease scaffold, such as for example an MT-SP1 scaffold, are tested in functional assays of complement activation. Assays for complement activation are described herein and can include any one or more of hemolytic assays and/or assays to detect activation products of one or more of the complement cascades. For example, enzyme immunoassays or ELISAs can be used to detect the presence of cleavage products of complement activation such as for example C4a, C5a, C3b, C3d, and C5-b9. Modified proteases that inhibit the activation of complement (such as by increasing CH50 levels as determined by a hemolytic assay or decreasing the detection of a complement cleavage product) can be identified as a "Hit". In one embodiment, combinations of "Hits" can be made to further increase the specificity and/or selectivity of a protease for inhibiting complement activation.

Modified proteases, such as for example a modified MT-SP1, that are identified as "Hits" for inhibiting complement activation in functional assays can be screened to determine the complement protein target substrate. Assays to detect for cleavage of a herein. In one example, a purified complement protein can be incubated in the presence or absence of a modified protease and analyzed and resolved on an SDS-PAGE gel and the protein cleavage products can be detected following staining with a protein stain such as Coomassie Brilliant Blue. Cleavage products can be excised and the peptide cleavage sequence can be determined by N-terminal sequencing. Using the identified peptide cleavage sequence as determined by empirically testing a library of modified proteases, further modified proteases can be identified and generated using the rational approach described above for Factor I cleavage sequences.

2. Methods of Assessing Specificity

Provided herein are methods of assessing substrate specificity of the resulting scaffold or modified proteases. In one embodiment, the specificity of any one or more of the S1-S4 sub-sites can be determined using ACC or AMC positional scanning libraries as discussed above. In another embodiment the specificity of a scaffold or modified protease for a target substrate compared to a non-target substrate can be determined using single substrate kinetic assays, see e.g., Harris, et al. (2000) *PNAS, 97*:7754. In specific embodiments, comparison of the specificities of a target protease and a scaffold protease can be used to determine if the modified protease exhibits altered, for example, increased, specificity compared to a scaffold protease.

The specificity of a protease for a target substrate can be measured by observing how many disparate sequences a modified protease cleaves at a given activity compared to a scaffold protease. If the modified protease cleaves fewer target substrates than the wildtype protease, the modified protease has greater specificity than the scaffold protease for those target substrates. The specificity of a protease for a target substrate can be determined from the specificity constant of cleavage of a target substrate compared to a non-target substrate (i.e. a native wildtype substrate sequence of a protease). A ratio of the specificity constants of a modified protease for a target substrate versus a non-target substrate can be made to determine a ratio of the efficiency of cleavage of the protease. Comparison of the ratio of the efficiency of cleavage between a modified protease and a scaffold protease can be used to assess the fold change in specificity for a target substrate. The fold change is an increase in specificity of a modified protease for a target substrate compared to a scaffold protease that is sufficient to achieve a predetermined alteration in complement activation or in a complement-mediated activity. Specificity can be at least 2-fold, at least 4-fold, at least 5-fold, at least 6-fold, at least 7-fold, 8, 9, 10, 20, 30, 40, 50, 60, 70, 80, 90, 100, 200, 300, 400, 500, 600, 700, 800, 900, 1000-fold or more when compared to the specificity of a scaffold protein for a target substrate versus a non-target substrate.

In one example, a modified protease that matches the desired specificity profiles, as determined by using positional scanning substrate libraries, can be assayed using individual peptide substrates corresponding to the desired target cleavage sequence compared to a non-target substrate cleavage sequence to determine the magnitude and change in specificity. In one embodiment, the individual peptide cleavage sequences can be attached to a fluorogenically tagged substrate, such as for example an ACC or AMC fluorogenic leaving group such as is described herein, and the release of the fluorogenic moiety can be determined as a measure of specificity of a protease for a peptide cleavage sequence. The rate of increase in fluorescence of a non-target substrate cleavage sequence or target cleavage sequence can be measured such as by using a fluorescence spectrophotometer. The rate of increase in fluorescence can be measured over time. Michaelis-Menton kinetic constants can be determined by the standard kinetic methods. The kinetic constants $k_{cat}$, $K_m$ and $k_{cat}/K_m$ can be calculated by graphing the inverse of the substrate concentration versus the inverse of the velocity of substrate cleavage, and fitting to the Lineweaver-Burk equation ($1/\text{velocity}=(K_m/V_{max})(1/[S])+1/V_{max}$; where $V_{max}[ET]k_{cat}$). The specificity constant ($k_{cat}/K_m$) is a measure of how well a substrate is cut by a particular protease.

In one embodiment, a non-target substrate cleavage sequence can be a native substrate cleavage sequence, such as a cleavage sequence recognized by wildtype MT-SP1. For example, efficient auto-activation of MT-SP1 entails recognition and cleavage of an Arg-Gln-Ala-Arg P4-P1 target sequence (SEQ ID NO: 718). MT-SP1 also can efficiently activate the proteinase-activated receptor-2 (PAR2), single chain uPA, and the hepatocyte growth factor/scatter factor. These extracellular surface-localized proteins display the P4 to P1 target sequences Ser-Lys-Gly-Arg (SEQ ID NO: 717), Pro-Arg-Phe-Lys (SEQ ID NO: 719), and Lys-Gln-Gly-Arg (SEQ ID NO: 720), respectively, which match closely the MT-SP1 cleavage specificity requirements observed for small peptidic substrates. In one embodiment, a fluorogenically tagged tetrapeptide of RQAR (SEQ ID NO: 401), or SLGR (SEQ ID NO: 392), or PRFK (SEQ ID NO: 402), or KQGR (SEQ ID NO: 403) can be used as a non-target substrate cleavage sequence.

In another embodiment, any one or more of the cleavage sequences of a complement protein can be determined and used as a desired target cleavage sequence. For example, any one or more of the Factor I cleavage sequences, such as for example SLLR (SEQ ID NO: 389), LPSR (SEQ ID NO: 388), and HRGR (SEQ ID NO: 390) can be used as a fluorogenically tagged tetrapeptide target cleavage sequence. In another example, the desired cleavage sequence in a complement protein targeted by any one or more wildtype or modified protease can be empirically determined by N-terminally sequencing cleavage products upon cleavage of any one or more of the complement proteins by a protease. In such an example, any one or more of the cleavage sequences identified as target cleavage sequences of a protease provided herein can be used, including those described in Example 3. Therefore, for example, a fluorogenically tagged tetrapeptide of GATR (SEQ ID NO: 391), SLGR (SEQ ID NO: 392), VFAK (SEQ ID NO: 393), REFK (SEQ ID NO: 394), QHAR (SEQ ID NO: 398), GLAR (SEQ ID NO: 395), RLGR (SEQ ID NO: 396), AEGK (SEQ ID NO: 397), or HRGR (SEQ ID NO: 390) can be used as a target substrate cleavage sequence.

In an additional embodiment, a full length complement protein can be used as a target substrate to assay for protease specificity compared to a full length native target substrate of a protease. Further, a full length complement protein can be used to assess the correlation between substrate specificity and cleavage by a protease of a full length target substrate versus a four amino acid P1-P4 substrate cleavage sequence contained within the target substrate. In one example, a full length C2 protein can be used as a desired cleavage target of any one or more or the proteases to assess specificity. In this example, cleavage of C2 by a modified or scaffold protease can be compared to cleavage of another full-length substrate, or the cleavage can be compared to a fluorogenic tetrapeptide cleavage sequence of C2, such as those described in Example 11 (i.e., GATR (SEQ ID NO: 721), SLGR (SEQ ID NO: 722), or VFAK (SEQ ID NO:

723)). The specificity constant of cleavage of a full length protein by a protease can be determined by using gel densitometry to assess changes in densitometry over time of a full-length target substrate band incubated in the presence of a protease.

3. Protease Polypeptides

Using the methods described herein, proteases are provided that cleave any one or more of the complement proteins, whereby cleavage of the complement protein inhibits complement activation. As provided herein, a protease polypeptide that cleaves any one or more of the complement proteins is a non-complement protease. A protease polypeptide can include the amino acid sequence of a scaffold protease whose sequence is provided herein, such as in any one of SEQ ID NOS: 2, 4, 8, 71, 73, 75, 77, 79, 81, 83, 85, 87, 89, 91, 93, 95, 97, 99, 101, 103, 105, 107, 109, 111, 113, 115, 117, 119, 121, 123, 125, 127, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 269, 270, 272, 274, 276, 278, 280, 282, 284, 286, 287, 289, 291, 293, 295, 297, 373, 375, 377, 379, 381, 383, 385, 387, 544, 545, 547, 549, and 551, or a catalytically active portion thereof. For example, the scaffold protease can be a wildtype or prominent form of the protease. In another embodiment, the scaffold protease can be an allelic variant of a protease. The scaffold protease is of mammalian origin, particularly human origin, although the scaffold protease polypeptide sequence also can be from any one or more of hamster, mouse, rat, cow, monkey, orangutan, baboon, chimpanzee, macaque, gibbon or gorilla origin. In other embodiments, the scaffold protease can be from non-mammalian origin such as from a plant or parasite.

In one embodiment, a protease scaffold is modified to have increased specificity and/or selectivity to any one or more complement proteins compared to the scaffold protease, while still encoding a protein that maintains its protease activity. Modified protease polypeptides include those with 1, 2, 3, 4, 5, 6, 7, 8, 9, 10, 11, 12, 13, 14, 15, 16, 17, 18, 19, 20 or more modified positions. Generally, a modified protease includes any variant in which residues at a particular position in the sequence have been substituted by other amino acids, and further include the possibility of inserting an additional residue or residues between two residues of the wildtype protease protein as well as the possibility of deleting one or more residues form the wildtype protease sequence. Any amino acid substitution, insertion, or deletion of a wildtype protease sequence is provided herein.

Provided herein are modified polypeptides that contain a full length sequence of a scaffold protease, but that contain modifications in any one or more amino acids that contribute to substrate specificity and/or selectivity. In one embodiment, the modified protease polypeptides provided herein have increased substrate specificity and/or selectivity for any one or more complement protein compared to a scaffold protease, whereby cleavage of a complement protein inhibits complement activation. In another embodiment, a modified protease polypeptide has a greater specificity for cleavage of a complement protein compared to a VEGF or VEGFR. In an additional embodiment, the modified proteases provided herein do not cleave a VEGF or VEGFR. Further, a modified protease polypeptide provided herein containing modifications in any one or more amino acids that contribute to substrate specificity and/or selectivity, also can contain other modifications in regions that are non-essential to the substrate specificity of a protease.

Modified protease polypeptides provided herein also can contain a catalytically active portion of a full-length scaffold or unmodified protease. When the polypeptide includes a catalytically active portion it can include other non-protease portions in addition thereto as long as the resulting polypeptide exhibits protease activity at least 1%, 2%, 5%, 10%, 20%, 50%, 100% or more of the full-length polypeptide. In addition the catalytically active portion is less than the full-length by at least one amino acid, and can be less than the full-length protease domain as long as protease activity is retained. A catalytically active portion of a protease containing modifications in any one or more amino acids that contribute to substrate specificity can be an active single-chain or double-chain form of a scaffold protease. In some embodiments, a modified protease can be substituted into another polypeptide, either at the N- or C-terminus, such as in a fusion protein. In additional embodiments, a modified polypeptide protease, such as for example a catalytically active portion thereof of a modified protease, can be inserted to replace the protease domain from another protease.

Provided herein are proteases exhibiting increased specificity and/or selectivity to any one or more complement proteins having a sequence of amino acids encompassed in any one of SEQ ID NOS: 298, 299, 300, 302, 304, 305, 306, 311, 312, 313, 314, 315, 316, 317, 318, 319, 320, 321, 322, 326, 328, 330, 332, 334, 335, 338, 340, 344, 660-662 or a fragment thereof that exhibits complement activity.

a. MT-SP1 Polypeptides

Provided herein are MT-SP1 polypeptides that cleave any one or more of the complement proteins, whereby cleavage of the complement protein inhibits complement activation. An MT-SP1 polypeptide provided herein can be a full-length MT-SP1 polypeptide (SEQ ID NO:2) or can be a fragment or partial sequence of full-length MT-SP1 that exhibits catalytic activity. In one example, an MT-SP1 polypeptide can be a single-chain protease domain of MT-SP1 (SEQ ID NO: 10). In another embodiment, an MT-SP1 polypeptide can be any one or more of the allelic variants of MT-SP1 as set forth in SEQ ID NO:448.

Also provided herein are modified MT-SP1 polypeptides containing modifications in any one or more amino acids of a scaffold MT-SP1 polypeptide using any one of the methods described herein. In one embodiment, the modifications can be made in a scaffold MT-SP1 set forth in SEQ ID NO:2, or can be made in any allelic variant of a wildtype MT-SP1 such as for example any one of the allelic variants set forth in SEQ ID NO:448. A modified MT-SP1 polypeptide provided herein can constitute a full-length sequence of an MT-SP1 scaffold, or can constitute a catalytically active portion thereof of a full-length MT-SP1 scaffold protease. The modified MT-SP1 exhibits an increase in the specificity and/or selectivity to any one or more of the complement proteins compared to a MT-SP1 scaffold, whereby cleavage of the protein inhibits complement activation.

Provided herein are modified MT-SP1 polypeptides with 1, 2, 3, 4, 5, 6, 7, 8, 9, 10, 11, 12, 13, 14, 15, 16, 17, 18, 19, 20 or more modified positions. In one embodiment, a modified MT-SP1 polypeptide includes mutation of any one or more amino acids in the extended substrate binding pocket of MT-SP1 including, for example, modification of any one or more amino acid residues of 195, 102, 57 (the catalytic triad); 189, 190, 191, 192, 216 and 226 (S1); 57, 58, 59, 60, 61, 62, 63, 64, 99 (S2); 146, 192, 217, 218 (S3); 96, 97, 98, 99, 100, 168, 169, 170, 170A, 171, 172, 173, 174, 175, 176, 178, 179, 180, 215, 217, 224 (S4), based on chymotrypsin numbering. Modifications in the protease domain of MT-SP1 to alter substrate specificity and/or selectivity also include modification of any one or more amino acid residues of 41, 60c, 143, 147, 151 or 221a, based on chymotrypsin numbering.

Provided herein are modified MT-SP1 polypeptides where the following amino acid residues were identified in the protease domain of MT-SP1 as increasing the specificity and/or selectivity of cleavage of any one or more complement protein thereby inhibiting complement activation: 41, 60c, 97, 143, 146, 147, 151, 172, 175, 192, 217, 221a, and 224 based on chymotrypsin numbering. The modified MT-SP1 polypeptides exhibit increased specificity and/or selectivity towards any one or more of the complement components compared to a wildtype MT-SP1 of SEQ ID NO: 2 or a catalytically active portion thereof set forth in SEQ ID NO:10. Thus, provided herein are modified MT-SP1 polypeptides exhibiting increased specificity and/or selectivity towards any one or more complement components containing a modification at an amino acid position corresponding to any one or more amino acid residues selected from among I41, R60$_C$, F97, H143, Y146, G147, G151, L172, Q175, Q192, D217, Q221$_a$ or K224 in an MT-SP1 set forth in SEQ ID NO: 2 or SEQ ID NO: 10, based on chymotrypsin numbering. In one embodiment, amino acid replacement or replacements correspond to any of the following positions: I41T, I41A, I41L, I41F, I41D, I41E, R60$_C$D, R60$_C$W, F97D, F97E, F97A, F97W, H143V, Y146N, Y146D, Y146E, Y146A, Y146W, Y146R, Y146F, G147E, G151L, L172N, Q175D, Q175E, Q175H, Q175L, Q175F, Q175W, Q175Y, Q175R, Q175K, Q192A, Q192R, Q192V, Q192F, D217F, Q221$_a$D, Q221$_a$L, Q221$_a$E, K224A, K224L, K224R, K224N, K224T, K224Y, K224S and K224F of the protease domain of MT-SP1 based on chymotrypsin numbering. Table 16 provides non-limiting examples of amino acid replacements that increase specificity and/or selectivity to any one or more complement protein, including SEQ ID NOS for exemplary polypeptide sequences and the encoding nucleic acid sequences.

TABLE 16

| ID # | Modification | Full-length SEQ ID NOS: (aa, nt) | Catalytically active portion SEQ ID NOS: (aa, nt) |
|---|---|---|---|
| CB200 | wildtype | 1, 2 | 10, 9 |
| CB12 | F97D | 406, 482 | 16, 15 |
| CB13 | F97E | 407, 483 | 18, 17 |
| CB16 | Y146F | 646 | 592 |
| CB17 | L172N | 647 | 593 |
| CB20 | Q175D | 636 | 582 |
| CB21 | Q175E | 635 | 581 |
| CB31 | F97A | 408, 484 | 20, 19 |
| CB32 | F97W | 409, 485 | 22, 21 |
| CB40 | Y146N | 410, 486 | 24, 23 |
| CB41 | Y146D | 411, 487 | 26, 25 |
| CB42 | Y146E | 412, 488 | 28, 27 |
| CB43 | Y146A | 413, 489 | 30, 29 |
| CB44 | Y146W | 414, 490 | 32, 31 |
| CB45 | Y146R | 415, 491 | 34, 33 |
| CB62 | Q192V | 405, 481 | 14, 13 |
| CB64 | Q192R | 416, 492 | 36, 35 |
| CB66 | K224A | 417, 493 | 38, 37 |
| CB67 | K224F | 418, 494 | 40, 39 |
| CB80 | R60$_C$D | 623 | 569 |
| CB82 | R60$_C$W | 621 | 567 |

TABLE 16-continued

| ID # | Modification | Full-length SEQ ID NOS: (aa, nt) | Catalytically active portion SEQ ID NOS: (aa, nt) |
|---|---|---|---|
| CB268 | Q221aD | 614 | 560 |
| CB274 | G147E | 622 | 568 |

Also provided herein are modified MT-SP1 polypeptides where the following amino acid residues were identified in the substrate binding site S1-S4 of MT-SP1 as increasing the specificity and/or selectivity of cleavage of any one or more complement protein containing a SLLR/SE Factor I cleavage sequence, thereby inhibiting complement activation: 96, 174, 217, 146, 192, and 99, based on chymotrypsin numbering. The modified MT-SP1 polypeptides exhibit increased specificity and/or selectivity towards a C3b or iC3 complement protein substrate compared to a native target substrate of wildtype MT-SP1 of SEQ ID NO: 2 or a catalytically active portion thereof set forth as SEQ ID NO:10. In one embodiment, amino acid replacement or replacements correspond to any of the following positions: D96A, D96V, D96F, D96S, D96T, Q174H, D217Q, D217N, D217H, Q192L, Q192I, Q192F, F99A, F99V, F99S, or F99G of the protease domain of MT-SP1 based on chymotrypsin numbering. Table 17 provides non-limiting examples of amino acid replacements that increase specificity and/or selectivity to any one or more complement protein, including SEQ ID NOS for exemplary polypeptide sequences and the encoding nucleic acid sequences.

TABLE 17

| Modification | Full-length SEQ ID NOS: | Catalytically active portion SEQ ID NOS: |
|---|---|---|
| D96A | 423, 499 | 45, 455 |
| D96V | 424, 500 | 46, 456 |
| D96F | 425, 501 | 47, 457 |
| D96S | 426, 502 | 48, 458 |
| D96T | 427, 503 | 49, 459 |
| Q174H | 419, 495 | 41, 451 |
| D217Q | 420, 496 | 42, 452 |
| D217N | 421, 497 | 43, 453 |
| D217H | 422, 498 | 44, 454 |
| Q192L | 428, 504 | 50, 460 |
| Q192I | 429, 505 | 51, 461 |
| Q192F | 430, 506 | 52, 462 |
| Y146F | 431, 507 | 53, 463 |
| F99A | 432, 508 | 54, 464 |
| F99V | 433, 509 | 55, 465 |
| F99S | 434, 510 | 56, 466 |
| F99G | 435, 511 | 57, 467 |

Also provided herein are modified MT-SP1 polypeptides where the following amino acid residues were identified in the substrate binding site S1-S4 of MT-SP1 as increasing the specificity and/or selectivity of cleavage of any one or more complement protein containing a LPSR/KI Factor I cleavage sequence, thereby inhibiting complement activation: 174, 180, 215, 192, and 99, based on chymotrypsin numbering. The modified MT-SP1 polypeptides exhibit increased specificity and/or selectivity towards a C3b or iC3 complement protein substrate compared to a native target substrate of wildtype MT-SP1 of SEQ ID NO: 2 or a catalytically active portion thereof set forth as SEQ ID NO:10. In one embodiment, amino acid replacement or replacements correspond to any of the following positions: Q174F, Q174V, Q174L, Q174Y, M180E, W215F, W215Y, Q192K, Q192R, Q192Y, or F99Y of the protease domain of MT-SP1 based on chymotrypsin numbering. Table 18 provides non-limiting examples of amino acid replacements that increase specificity and/or selectivity to any one or more complement protein, including SEQ ID NOS for exemplary polypeptide sequences and the encoding nucleic acid sequences.

TABLE 18

| Modification | Full-length SEQ ID NOS: | Catalytically active portion SEQ ID NOS: |
|---|---|---|
| Q174F | 440, 516 | 62, 472 |
| Q174V | 439, 515 | 61, 471 |
| Q174L | 529, 539 | 524, 534 |
| Q174Y | 530, 540 | 525, 535 |
| M180E | 531, 541 | 526, 536 |
| W215F | 436, 512 | 58, 468 |
| W215Y | 437, 513 | 59, 469 |
| Q192K | 532, 542 | 527, 537 |
| Q192R | 416, 492 | 35, 36 |
| Q192Y | 533, 543 | 528, 538 |
| F99Y | 447, 523 | 69, 479 |

Also provided herein are modified MT-SP1 polypeptides where the following amino acid residues were identified in the substrate binding site S1-S4 of MT-SP1 as increasing the specificity and/or selectivity of cleavage of any one or more complement protein containing a HRGR/TL Factor I cleavage sequence, thereby inhibiting complement activation: 174, 215, 192, 217, and 99 based on chymotrypsin numbering. The modified MT-SP1 polypeptides exhibit increased specificity and/or selectivity towards a C4b or iC4 complement protein substrate compared to a native target substrate of wildtype MT-SP1 of SEQ ID NO: 2 or a catalytically active portion thereof set forth as SEQ ID NO:10. In one embodiment, amino acid replacement or replacements correspond to any of the following positions: W215F, W215Y, Q174A, Q174V, Q174F, Q174R, Q174K, D217A, D217V, Q192E, F99W, and F99Y of the protease domain of MT-SP1 based on chymotrypsin numbering. Table 19 provides non-limiting examples of amino acid replacements that increase specificity and/or selectivity to any one or more complement protein, including SEQ ID NOS for exemplary polypeptide sequences and the encoding nucleic acid sequences.

TABLE 19

| Modification | Full-length SEQ ID NOS: | Catalytically active portion SEQ ID NOS: |
|---|---|---|
| W215F | 436, 512 | 58, 468 |
| W215Y | 437, 513 | 59, 469 |
| Q174A | 438, 514 | 60, 470 |
| Q174V | 439, 515 | 61, 471 |
| Q174F | 440, 516 | 62, 472 |
| Q174R | 441, 517 | 63, 473 |

TABLE 19-continued

| Modification | Full-length SEQ ID NOS: | Catalytically active portion SEQ ID NOS: |
|---|---|---|
| Q174K | 442, 518 | 64, 474 |
| D217A | 443, 519 | 65, 475 |
| D217V | 444, 520 | 66, 476 |
| Q192E | 445, 521 | 67, 477 |
| F99W | 446, 522 | 68, 478 |
| F99Y | 447, 523 | 69, 479 |

In one embodiment, modified proteases can be combined such as, for example, to acquire the specificity of multiple proteases. A mutation at one residue of a protease scaffold, which produces specificity at one site of a substrate sequence, can be combined in the same protease with another mutation at another site of the protease scaffold sequence to make a combined specificity protease. Any number of mutations at discrete sites on the same protease scaffold can be used to create a combined specificity protease. A modified protease can contain 2, 3, 4, 5, 6, 7, 8, 9, 10, 11, 12, 13, 14, 15, 16, 17, 18, 19, 20, or more mutations by combining any two or more mutations identified as contributing to substrate specificity and/or selectivity of the protease.

For example, a modified MT-SP1 protease can contain any two or more mutations, such as any two or more mutations set forth above, to generate a combined protease. Provided herein are modified MT-SP1 polypeptides having two or more modifications corresponding to any of positions 41, 60c, 96, 97, 99, 143, 146, 147, 151, 172, 174, 175, 192, 215, 217, 221a, and 224, based on chymotrypsin numbering. The modified MT-SP1 polypeptide exhibits increased specificity and/or selectivity to any one or more complement components compared to a scaffold or wildtype MT-SP1 of SEQ ID NO: 2 or a catalytically active portion thereof set forth in SEQ ID NO: 10. Thus, provided herein are modified MT-SP1 polypeptides exhibiting increased specificity and/or selectivity towards any one or more complement components containing two or more modifications at an amino acid position corresponding to any two or more amino acid residues selected from among I41, R60$_C$, D96, F97, F99, H143, Y146, G147, G151, L172, Q174, Q175, Q192, W215, D217, Q221$_a$ and K224 in an MT-SP1 set forth in SEQ ID NO: 2 or SEQ ID NO:10, based on chymotrypsin numbering. In some examples, a modified MT-SP1 containing two or more modifications contains a modification at one or both of position Y146 and K224. In another example, a modified MT-SP1 containing two or more modifications contains a modification at position G151. Modified MT-SP1 polypeptides can be generated using any of the methods disclosed herein. Table 20 provides non-limiting examples of amino acid replacements that increase specificity and/or selectivity to any one or more complement protein, including SEQ ID NOS for exemplary polypeptide sequences and the encoding nucleic acid sequences.

TABLE 20

| ID # | Modification | Full-length SEQ ID NOS: | Catalytically active portion SEQ ID NOS: |
|---|---|---|---|
| CB155 | Y146D/K224F | 404, 480 | 11, 12 |
| CB212 | Y146N/K224F | 655 | 601 |
| CB213 | Y146E/K224F | 642 | 588 |
| CB214 | Y146A/K224F | 643 | 589 |
| CB216 | Q192V/K224F | 659 | 605 |
| CB218 | Q192F/K224F | 657 | 603 |

TABLE 20-continued

| ID # | Modification | Full-length SEQ ID NOS: | Catalytically active portion SEQ ID NOS: |
|---|---|---|---|
| CB219 | Y146D/Q192A/K224F | 658 | 604 |
| CB232 | Y146E/K224L | 620 | 566 |
| CB235 | Y146E/K224A | 630 | 576 |
| CB238 | Y146D/K224L | 628 | 574 |
| CB244 | Y146D/K224R | 617 | 563 |
| CB245 | Y146D/K224N | 637 | 583 |
| CB251 | Y146E/K224R | 615 | 561 |
| CB252 | Y146E/K224N | 606 | 552 |
| CB255 | Y146E/K224T | 644 | 590 |
| CB257 | Y146E/K224Y | 633 | 579 |
| CB331 | I41D/Y146D/K224L | 653 | 599 |
| CB332 | I41E/Y146D/K224L | 639 | 585 |
| CB349 | I41D/Y146D/K224F | 654 | 600 |
| CB350 | I41E/Y146D/K224F | 652 | 598 |
| CB351 | I41T/Y146D/K224F | 608 | 554 |
| CB353 | H143V/Y146D/K224F | 641 | 587 |
| CB357 | I41T/Y146D/K224L | 626 | 572 |
| CB367 | Y146D/Q175D/K224R | 624 | 570 |
| CB373 | Y146E/Q175D/K224R | 619 | 565 |
| CB377 | Y146E/Q175D/K224N | 616 | 562 |
| CB381 | Y146D/Q175H/K224L | 631 | 577 |
| CB383 | Y146D/Q175L/K224L | 625 | 571 |
| CB385 | Y146D/Q175F/K224L | 634 | 580 |
| CB387 | Y146D/Q175W/K224L | 627 | 573 |
| CB388 | Y146D/Q175Y/K224L | 632 | 578 |
| CB403 | Y146D/D217F/K224L | 640 | 586 |
| CB409 | I41A/Y146D/K224F | 651 | 597 |
| CB412 | I41L/Y146D/K224F | 649 | 595 |
| CB413 | I41F/Y146D/K224F | 648 | 594 |
| CB421 | I41T/Y146D/Q175D/K224F | 656 | 602 |
| CB422 | I41T/Y146E/Q175D/K224N | 609 | 555 |
| CB423 | I41T/Y146E/K224L | 645 | 591 |
| CB450 | I41T/I46D/G151L/K224F | 650 | 596 |
| CB451 | Y146D/Q221aL/K224S | 638 | 584 |
| CB458 | Y146E/Q221aE/K224R | 629 | 575 |
| CB464 | Y146E/Q221aE/k224F | 611 | 557 |
| CB476 | I41T/Y146D/Q175D/K224L | 663 | 672 |
| CB477 | I41T/Y146D/Q175D/K224R | 664 | 673 |
| CB478 | I41T/Y146D/Q175D/K224N | 665 | 674 |
| CB480 | I41T/Y146D/G151L/Q175D/K224F | 666 | 675 |
| CB481 | I41T/Y146D/G151L/Q175D/K224L | 667 | 676 |
| CB482 | I41T/Y146D/G151L/Q175D/K224R | 668 | 677 |
| CB483 | I41T/Y146D/G151L/Q175D/K224N | 669 | 678 |
| CB484 | I41T/Y146E/Q175D/K224F | 670 | 679 |
| CB485 | I41T/Y146E/Q175D/K224L | 671 | 680 |
| CB486 | I41T/Y146E/Q175D/K224R | 607 | 553 |
| CB487 | I41T/Y146D/G151L/Q175D/K224N | 613 | 559 |
| CB488 | I41T/Y146E/G151L/Q175D/K224F | 618 | 564 |
| CB489 | I41T/Y146E/G151L/Q175D/K224L | 610 | 556 |
| CB490 | I41T/Y146E/G151L/Q175D/K224R | 612 | 558 |
| | I41T/Y146D/G151L/K224N | 681 | 696 |
| | Y146D/Q175D/K224N | 682 | 697 |
| | I41T/Y146D/K224N | 683 | 698 |
| | Y146D/G151L/K224N | 684 | 699 |
| | Y146D/Q175R/K224N | 685 | 700 |
| | Y146D/Q175K/K224N | 686 | 701 |
| | Y146D/Q175H/K224N | 687 | 702 |
| | I41T/Y146D/G151L/Q175K/K224F | 688 | 703 |
| | I41T/Y146D/G151L/Q175R/K224F | 689 | 704 |
| | I41T/Y146D/G151L/Q175H/K224F | 690 | 705 |
| | I41T/Y146D/G151L/Q175Y/K224F | 691 | 706 |
| | I41T/Y146D/G151L/Q175K/K224N | 692 | 707 |
| | I41T/Y146D/G151L/Q175R/K224N | 693 | 708 |
| | I41T/Y146D/G151L/Q175H/K224N | 694 | 709 |
| | I41T/Y146D/G151L/Q175Y/K224N | 695 | 710 |

Provided herein are modified MT-SP1 polypeptides where the replacement(s) are made in an MT-SP1 polypeptide scaffold having a sequence of amino acids set forth in SEQ ID NO: 2, where the modified MT-SP1 polypeptide exhibits increased specificity and/or selectivity to any one or more complement components compared to the unmodified protein. Also provided herein are modified MT-SP1 polypeptides containing replacement(s) in an MT-SP1 scaffold having a sequence of amino acids set forth in SEQ ID NO: 10, where the modified MT-SP1 polypeptide exhibits increased specificity and/or selectivity to any one or more complement components compared to the unmodified protein. Such an MT-SP1 scaffold polypeptide is a catalytically active portions thereof of an MT-SP1 polypeptide. Exemplary modified MT-SP1 polypeptides provided herein containing modification(s) of a catalytically active portion thereof of a full-length MT-SP scaffold have a sequence of amino acids as set forth in any one of SEQ ID NOS: 12, 14, 16, 18, 20, 22, 24, 26, 28, 30, 32, 34, 36, 38, 40-69, 524-528, 552-605, 672-680, or 696-710. Exemplary modified MT-SP1 polypeptides provided herein containing modification(s) of a full-length MT-SP1 scaffold have a sequence of amino acids as set forth in any one of SEQ ID NOS: 404-418-447, 529-533, 606-659, 663-671, or 681-695.

E. ASSAYS TO ASSESS OR MONITOR MODIFIED PROTEASE ACTIVITIES ON COMPLEMENT-MEDIATED FUNCTIONS

A modified protease can exhibit alterations in specificity and/or selectivity to any one or more complement proteins and thereby inactivate any one or more complement proteins compared to the corresponding full-length, scaffold or wild-type form of the complement protein. Modified proteases retain their protease activity, but can exhibit an increased specificity and/or selectivity to any one or more complement proteins. Exemplary proteases specifically cleave any one or more complement protein and thereby alter the activity of a complement protein. All such scaffold or modified proteases with increased specificity and/or selectivity to any one or more complement protein are candidate therapeutics.

Where the protease exhibits an increased specificity and/or selectivity to any one or more complement protein, in vitro and in vivo assays can be used to monitor or screen proteases for effects on complement-mediated functions. Such assays are well known to those of skill in the art. One of skill in the art can test a particular scaffold or modified protease for cleavage of any one or more complement protein and/or test to assess any change in the effects of a protease on a complement-mediated activity compared to the absence of a protease. Some such assays are exemplified herein.

Exemplary in vitro and in vivo assays are provided herein for comparison of an activity of a scaffold or modified protease on the function of any one or more targeted complement proteins. Many of the assays are applicable to other proteases and modified proteases. In addition, numerous assays, such as assays for measuring complement activation, are known to one of skill in the art. Assays for activities of complement include, but are not limited to, assays that measure activation products of complement activation, such as for example the C5b-9 MAC complex, and generation of any one or more of the complement cleavage products such as C4a, C5a, C3b, and C3d. Assays to measure complement activation also include functional assays that measure the functional activity of specific components of the complement pathways, such as for example hemolytic assays used to measure activation of any one of the classical, lectin or alternative pathways. Assays to assess effects of proteases and modified proteases on complement proteins and/or complement-mediated functions include, but are not limited to, SDS-analysis followed by Western Blot or Coomassie Brilliant Blue staining, enzyme immunoassays, and hemolytic assays. In one example, in vitro assays can be performed using purified complement proteins. In another example, in vivo assays can be performed by testing the serum of a species, including mammalian or human species, for functional activation of complement. Exemplary assays are described below.

a. Protein Detection

Protein detection is a means to measure individual complement components in a sample. Complement proteins can be detected to assess directly the effects of a scaffold or modified protease on cleavage of the proteins, or alternatively, complement proteins can be measured as a means to assess for complement activation. Complement proteins, treated in the presence or absence of a scaffold or modified protease, can be analyzed by any one or more assays including SDS-PAGE followed by Coomassie staining or Western Blot, enzyme immunoassay, immunohistochemistry, flow cytometry, nephelometry, agar gel diffusion, or radial immunodiffusion. Exemplary assays for protein detection are described below.

i. SDS-PAGE Analysis

Analysis of complement proteins in the presence or absence of increasing concentrations of a scaffold or modified protease can be performed by analysis of proteins on SDS-PAGE followed by detection of those proteins. In such examples, complement proteins can be detected by staining for total protein, such as by Coomasie Brilliant Blue stain, Silver stain, or by any other method known to one of skill in the art, or by Western Blot using polyclonal or monoclonal antibodies specific for a specified protein. Typically, a purified complement protein, such as for example any one or more of the proteins involved in the complement pathways, can be incubated in the presence or absence of a scaffold or modified protease. The treated complement protein can be resolved on an SDS-PAGE gel followed by a method to detect protein in the gel, for example, by staining with Coomasie Brilliant blue. The treated protein can be compared to its cognate full length protein and the degradation products formed by protease cleavage of the protein can be determined.

In another embodiment, a sample, such as for example human serum or plasma, can be treated in the presence or absence of a scaffold or modified protease or can be collected after treatment of an animal or a human with or without a protease. The protease-treated sample can be analyzed on SDS-PAGE and a specific complement protein can be detected, such as for example C1q, MBL, C2, C3, C4, C5, or Factor B, by Western Blot using monoclonal or polyclonal antibodies against the protein. The cleavage of the complement protein can be compared to a sample that was not treated with a protease. Additionally, the sample can be stimulated to initiate complement activation such as by incubation with IgG which stimulates activation of the classical pathway or by LPS which stimulates activation of the alternative pathway. The sample can be resolved by SDS-PAGE for detection of any one or more of the native complement proteins to determine the presence or absence of cleavage products of a specified protein compared to a sample of the protein not treated with a protease. In such examples, cleavage effector molecules of native complement proteins also can be analyzed by Western Blot using monoclonal and polyclonal antibodies to assess the activation of one or more of the complement pathways. Examples of complement effector molecules can include, but are not limited to, C3a, C3d, iC3b, C4d, Bb, and C5-b9. For example, a decreased expression in a sample of C4d can indicate that a scaffold or modified protease inhibited the activation of one or more of the classical or lectin pathway of complement. In another example, a decreased expression in a sample of Bb can indicate that a scaffold or modified protease inhibited the activation of the alternative pathway of complement. The cleavage products of the effector molecules also can be determined to assess the effects of ii. Enzyme Immunoassay Enzyme immunoassay (EIA; also called enzyme-linked immunosorbent assay; ELISA) is an assay used to measure the presence of a protein in a sample. Typically, measurement of the protein is an indirect measurement of the binding of the protein to an antibody, which itself is chemically labeled with a detectable substrate such as an enzyme or fluorescent compound. EIA assays can be used to measure the effects of scaffold or modified proteases on complement activation by measuring for the presence of a complement effector molecule generated following complement activation. In such examples, a sample, such as for example human serum or plasma, can be pretreated in the presence or absence of increasing concentrations of a scaffold or modified protease and subsequently activated to induce complement activation by incubation with initiating molecules, or can be collected following treatment of an animal or a human with a protease. For example, the classical pathway can be activated by incubation with IgG and the alternative pathway can be activated by incubation of the sample with LPS. A complement activation assay specific for the lectin pathway requires that the classical pathway of complement is inhibited since the C4/C2 cleaving activity of the lectin pathway is shared with the classical pathway of complement Inhibition of the classical pathway can be achieved using a high ionic strength buffer which inhibits the binding of C1q to immune complexes and disrupts the C1 complex, whereas a high ionic strength buffer does not affect the carbohydrate binding activity of MBL. Consequently, activation of the lectin pathway can be induced by incubation of a sample, such as human serum or plasma, with a mannan-coated surface in the presence of 1 M NaCl.

Following activation, the sample can be quenched with the addition of Pefabloc (Roche) and EDTA to minimize continued activation of the pathways. Samples can be analyzed for the presence of complement effector molecules by an EIA or ELISA assay. EIA and ELISA assays for measuring complement proteins are well known to one skilled in the art. Any complement activation product can be assessed. Exemplary complement activation products for measurement of complement activation include iC3b, Bb, C4d, C5b-9, C3a, C3a-desArg, C4a-desArg, and C5a-desArg. The complement pathway activated can be determined depending on the complement activation product measured. For example, measurement of Bb cleavage product is a unique marker of the alternative pathway.

In some examples, the EIA can be paired with detection of the cleaved complement proteins by analysis of the protease-treated, complement-stimulated sample by SDS-PAGE followed by Western blot analysis for identification of specific complement components. Using densitometry software, the cleavage of the complement product can be compared to the full length complement component cleaved throughout the assay and the appearance of all major degradation products and the percentage cleavage can be determined.

iii. Radial Immunodiffusion (RID)

Radial immunodiffusion (RID) is a technique that relies on the precipitation of immune complexes formed between antibodies incorporated into agarose gels when they are poured, and antigen present in a test sample resulting in a circular precipitin line around the sample well. The diameter of the precipitin ring is proportional to the concentration of the antibody (or antigen) present in the test sample. By comparing the diameter of the test specimen precipitin ring to known standards, a relatively insensitive estimation of the concentration of specific antibody or antigen can be achieved. RID can be used to measure the amount of a complement protein in a sample. For example, a sample such as for example human serum or plasma, can be treated in the presence or absence of increasing concentrations of a scaffold or modified protease. The protease-treated sample can be added to a well of an agarose gel that has been made to incorporate a polyclonal or monoclonal antibody against any one of the complement proteins such as including, but not limited to, C1q, C1r, C1s, C2, C3, C4, C5, C6, C7, C9, or Factor B. After removal of unprecipitated proteins by exposure to 0.15 M NaCl, the precipitated protein rings can be assessed by staining with a protein dye, such as for example Coomassie Brilliant blue or Crowles double stain.

b. Hemolytic Assays

Functional hemolytic assays provide information on complement function as a whole. This type of assay uses antibody-sensitized or unsensitized sheep erythrocytes. Hemolytic assays include the total hemolytic complement assay (CH50), which measures the ability of the classical pathway and the MAC to lyse a sheep RBC. It depends on the sequential activation of the classical pathway components (C1 through C9) to lyse sheep erythrocytes that have been sensitized with optimal amounts of rabbit anti-sheep erythrocyte antibodies to make cellular antigen-antibody complexes. Hemolytic assays also can include an alternative pathway CH50 assay (rabbit CH50 or APCH50), which measures the ability of the alternative pathway and the MAC to lyse a rabbit RBC. One CH50 and/or APCH50 unit is defined as the quantity or dilution of serum required to lyse 50% of the red cells in the test. Typically, to assess complement activation, a sample, such as for example human serum or human plasma, can be treated in the presence or absence of increasing concentrations of a scaffold or modified protease, or can be collected following treatment of an animal or human in the presence or absence of a protease. The protease-treated sample can be subsequently mixed with sheep's red blood cells that have been activated or sensitized with IgG. A water only sample mixed with sheep red blood cells can act as a total lysis control in order to accurately assess percent lysis of the samples analyzed. The addition of 0.15M NaCl to the sample can be added to stop the lysing reaction. Lysis of the red blood cells, induced by the activation of the terminal components of the complement pathway, can be assessed by measuring the release of hemoglobin. Measurement can be by optical density (OD) readings of the samples using a spectrophotometer at an OD of 415 nm.

In one embodiment, limiting dilution hemolytic assays can be used to measure functional activity of specific components of either pathway. In such an assay, a serum source is used that has an excess of all complement components, but is deficient for the one being measured in the sample, i.e. a media or serum source is complement-depleted for a specific protein. The extent of hemolysis is therefore dependent on the presence of the measured component in the test sample. In such an assay, a purified complement protein, such as for example any one of the native complement proteins including, but not limited to C1q, MBL, C2, C3, C4, or C5 can be incubated in the presence or absence of increasing concentrations of a scaffold or modified protease. The protease-treated purified complement protein can then be mixed with complement-depleted media or plasma and IgG-activated sheep red blood cells and hemolysis of the sample can be assessed as described above. In another embodiment, protease cleavage can be correlated with complement activation by assaying for hemolytic activity of a protease-treated sample, and subsequently analyzing the sample on SDS-PAGE gel followed by staining with a protein stain, such as for example Coomassie Blue. The purified complement protein treated with the proteases can be assessed for cleavage and the percentage of the full length complement component cleaved throughout the assay and the appearance of all major degradation products can be calculated. Alternatively, analysis of the protease-treated complement protein can be by Western blot.

An alternative to the hemolytic assay, called the liposome immunoassay (LIA), can be used to assess activation of the classical pathway. The LIA (Waco Chemicals USA, Richmond, Va.) utilizes dinitrophenyl (DNP)-coated liposomes that contain the enzyme glucose-6-phosphate dehydrogenase. When serum is mixed with the liposomes and a substrate containing anti-DNP antibody, glucose-6-phosphate, and nicotinamide adenine dinucleotide, activated liposomes lyse, and an enzymatic colorimetric reaction occurs which is proportional to total classical complement activity.

F. METHODS OF PRODUCING NUCLEIC ACID ENCODING PROTEASES AND METHODS OF PRODUCING PROTEASE POLYPEPTIDES

Protease polypeptides, including modified MT-SP1 polypeptides, or domains thereof, can be obtained by methods well known in the art for protein purification and recombinant protein expression. Any method known to those of skill in the art for identification of nucleic acids that encode desired genes can be used. Any method available in the art can be used to obtain a full length (i.e., encompassing the entire coding region) cDNA or genomic DNA clone encoding a protease protein, such as from a cell or tissue source. Modified proteases can be engineered as described herein from a scaffold or wildtype protease, such as by site-directed mutagenesis.

Proteases can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a protease, including for example, polymerase chain reaction (PCR) methods. A nucleic acid containing material can be used as a starting material from which a protease-encoding nucleic acid molecule can be isolated. For example, DNA and mRNA preparations, cell extracts, tissue extracts, fluid samples (e.g. blood, serum, saliva), samples from healthy and/or diseased subjects can be used in amplification methods. Nucleic acid libraries also can be used as a source of starting material. Primers can be designed to amplify a protease. For example, primers can be designed based on expressed sequences from which a protease is generated. Primers can be designed based on back-translation of a protease amino acid sequence. Nucleic acid molecules generated by amplification can be sequenced and confirmed to encode a protease.

Additional nucleotide sequences can be joined to a protease-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a protease-encoding nucleic acid molecule. Examples of such sequences include, but are not limited to, promoter sequences designed to facilitate intracellular protein expression, and secretion sequences designed to facilitate protein secretion. Additional nucleotide sequences such as sequences specifying protein binding regions also can be linked to protease-encoding nucleic acid molecules. Such regions include, but are not limited to, sequences to facilitate uptake of a protease into specific target cells, or otherwise enhance the pharmacokinetics of the synthetic gene.

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pBR322 or pUC plasmid derivatives or the Bluescript vector (Stratagene, La Jolla, Calif.). The insertion into a cloning vector can, for example, be accomplished by ligating the DNA fragment into a cloning vector which has complementary cohesive termini. Insertion can be effected using TOPO cloning vectors (INVITROGEN, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protease protein gene can be modified by homopolymeric tailing. Recombinant molecules can be introduced into host cells via, for example, transformation, transfection, infection, electroporation and sonoporation, so that many copies of the gene sequence are generated.

In specific embodiments, transformation of host cells with recombinant DNA molecules that incorporate the isolated protease protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

1. Vectors and Cells

For recombinant expression of one or more of the protease proteins, the nucleic acid containing all or a portion of the nucleotide sequence encoding the protease protein can be inserted into an appropriate expression vector, i.e., a vector that contains the necessary elements for the transcription and translation of the inserted protein coding sequence. The necessary transcriptional and translational signals also can be supplied by the native promoter for protease genes, and/or their flanking regions.

Also provided are vectors that contain nucleic acid encoding the protease or modified protease. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a protease or modified protease protein thereof by growing the above-described cells under conditions whereby the encoded protease protein is expressed by the cell, and recovering the expressed protease protein. For purposes herein, the protease can be secreted into the medium.

In one embodiment, vectors containing a sequence of nucleotides that encodes a polypeptide that has protease activity and contains all or a portion of the protease domain, or multiple copies thereof, are provided. Also provided are vectors that contain a sequence of nucleotides that encodes the protease domain and additional portions of a protease protein up to and including a full length protease protein, as well as multiple copies thereof. The vectors can be selected for expression of the scaffold or modified protease protein or protease domain thereof in the cell or such that the protease protein is expressed as a secreted protein. When the protease domain is expressed the nucleic acid is linked to nucleic acid encoding a secretion signal, such as the *Saccharomyces cerevisiae* a-mating factor signal sequence or a portion thereof, or the native signal sequence.

A variety of host-vector systems can be used to express the protein coding sequence. These include but are not limited to mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding a scaffold or modified protease protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a protease protein. Promoters which can be used include but are not limited to the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983)); see also "Useful Proteins from Recombinant Bacteria": in Scientific American 242: 79-94 (1980)); plant expression vectors containing the nopaline synthetase promoter (Herrar-Estrella et al., *Nature* 303: 209-213 (1984)) or the cauliflower mosaic virus 35S RNA promoter (Garder et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell. Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinckert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel.* 1:161-171 (1987)), beta globin gene control region which is active in myeloid cells (Mogram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Sani, *Nature* 314:283-286 (1985)), and gonadotrophic releasing hormone gene control region which is active in gonadotrophs of the hypothalamus (Mason et al., *Science* 234:1372-1378 (1986)).

In a specific embodiment, a vector is used that contains a promoter operably linked to nucleic acids encoding a scaffold or modified protease protein, or a domain, fragment, derivative or homolog, thereof, one or more origins of replication, and optionally, one or more selectable markers (e.g., an antibiotic resistance gene). Vectors and systems for expression of the protease domains of the protease proteins include the well known *Pichia* vectors (available, for example, from Invitrogen, San Diego, Calif.), particularly those designed for secretion of the encoded proteins. Exemplary plasmid vectors for transformation of *E. coli* cells, include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6×His tag coding sequence, $t_0$ and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32 (SEQ ID NO: 345), pQE 30, and pQE 31 which provide multiple cloning sites for all three reading frames and provide for the expression of N-terminally 6×His-tagged proteins. Other exemplary plasmid vectors for transformation of *E. coli* cells, include, for example, the pET expression vectors (see, U.S. Pat. No. 4,952,496; available from NOVAGEN, Madison, Wis.; see, also literature published by Novagen describing the system). Such plasmids include pET 11a, which contains the T71ac promoter, T7 terminator, the inducible *E. coli* lac operator, and the lac repressor gene; pET 12a-c, which contains the T7 promoter, T7 terminator, and the *E. coli* ompT secretion signal; and pET 15b and pET 19b (NOVAGEN, Madison, Wis.), which contain a His-Tag™ leader sequence for use in purification with a His column and a thrombin cleavage site that permits cleavage following purification over the column, the T7-lac promoter region and the T7 terminator.

2. Expression

Modified proteases can be produced by any method known to those of skill in the art including in vivo and in vitro methods. Modified proteases can be expressed in any organism suitable to produce the required amounts and forms of a modified protease needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Many expression vectors are available and known to those of skill in the art and can be used for expression of modified proteases. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Modified proteases also can be utilized or expressed as protein fusions. For example, a protease fusion can be generated to add additional functionality to a protease. Examples of protease fusion proteins include, but are not limited to, fusions of a signal sequence, a tag such as for localization, e.g. a his$_6$ tag or a myc tag, or a tag for purification, for example, a GST fusion, and a sequence for directing protein secretion and/or membrane association.

In one embodiment, the protease can be expressed in an active form. In another embodiment, the protease is expressed in an inactive, zymogen form.

a. Prokaryotes

Prokaryotes, especially *E. coli*, provide a system for producing large amounts of proteins such as proteases or modified proteases. Transformation of *E. coli* is simple and rapid technique well known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λPL promoter.

Modified proteases can be expressed in the cytoplasmic environment of *E. coli*. The cytoplasm is a reducing environment and for some molecules, this can result in the formation of insoluble inclusion bodies. Reducing agents such as dithiothreotol and β-mercaptoethanol and denaturants, such as guanidine-HCl and urea can be used to resolubilize the proteins. An alternative approach is the expression of a modified protease in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast

Yeasts such as *Saccharomyces cerevisae, Schizosaccharomyces pombe, Yarrowia lipolytica, Kluyveromyces lactis* and *Pichia pastoris* are well known yeast expression hosts that can be used for production of modified proteases. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces* cerevisae and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insect Cells

Insect cells, particularly using baculovirus expression, are useful for expressing polypeptides such as modified proteases. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schnieder 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express modified proteases. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha-1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase and thymidine kinase. Fusion with cell surface signaling molecules such as TCR-$\zeta$ and Fc$_\epsilon$RI-$\gamma$ can direct expression of the proteins in an active state on the cell surface.

Many cell lines are available for mammalian expression including mouse, rat human, monkey, chicken and hamster cells. Exemplary cell lines include, but are not limited to, CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. One such example is the serum free EBNA-1 cell line (Pham et al., (2003) *Biotechnol. Bioeng.* 84:332-42.)

e. Plants

Transgenic plant cells and plants can be used to express modified proteases. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce proteases or modified proteases (see for example, Mayfield et al. (2003) *PNAS* 100:438-442). Because plants have different glycosylation patterns than mammalian cells, this can influence the choice of proteases or modified proteases produced in these hosts.

3. Purification Techniques

Methods for purification of protease polypeptides from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary the proteins can be extracted and further purified using standard methods in the art.

The protease can be expressed and purified to be in an inactive form (zymogen form) or alternatively the expressed protease can be purified into an active form by autocatalysis to remove the proregion. Typically, the autoactivation occurs during the purification process, such as by incubating at room temperature for 24-72 hours. The rate and degree of activation is dependent on protein concentration and the specific modified protease, such that for example, a more dilute sample can need to be incubated at room temperature for a longer period of time. Activation can be monitored by SDS-PAGE (a 3 kilodalton shift) and by enzyme activity (cleavage of a fluorogenic substrate). Typically, a protease is allowed to achieve >75% activation before purification.

Proteases can be purified using standard protein purification techniques known in the art including, but not limited to, SDS-PAGE, size fraction and size exclusion chromatography, ammonium sulfate precipitation and ionic exchange chromatography, such as anion exchange. Affinity purification techniques also can be utilized to improve the efficiency and purity of the preparations. For example, antibodies, receptors and other molecules that bind proteases can be used in affinity purification. Expression constructs also can be engineered to add an affinity tag to a protein such as a myc epitope, GST fusion or His$_6$ and affinity purified with myc antibody, glutathione resin and Ni-resin, respectively. Purity can be assessed by any method known in the art including gel electrophoresis and staining and spectrophotometric techniques.

4. Fusion Proteases

Fusion proteins containing a protease and one or more other polypeptides also are provided. Pharmaceutical compositions containing such fusion proteins formulated for administration by a suitable route are provided. Fusion proteins are formed by linking in any order the scaffold or modified protease and another polypeptide, such as an antibody or fragment thereof, growth factor, receptor, ligand and other such agent for the purposes of facilitating the purification of a protease, altering the pharmacodynamic properties of a protease by directing the protease to a targeted cell or tissue, and/or increasing the expression or secretion of a protease. Within a protease fusion protein, the protease polypeptide can correspond to all or a catalytically active portion thereof of a wildtype or scaffold protease protein. In some embodiments, the protease or catalytically active portion thereof is a modified protease. Fusion proteins provided herein retain substantially all of their specificity and/or selectivity for any one or more of the complement proteins. Generally, protease fusion polypeptides retain at least about 30%, 40%, 50%, 60%, 70%, 80%, 85%, 90% or 95% substrate specificity and/or selectivity compared with a non-fusion protease, including 96%, 97%, 98%, 99% or greater substrate specificity compared with a non-fusion protease.

Linkage of a protease polypeptide and another polypeptide can be effected directly or indirectly via a linker. In one example, linkage can be by chemical linkage, such as via heterobifunctional agents or thiol linkages or other such linkages. Fusion of a protease to another polypeptide can be to the N- or C-terminus of the protease polypeptide. Non-limiting examples of polypeptides that can be used in fusion proteins with a protease provided herein include, for example, a GST (glutathione S-transferase) polypeptide, Fc domain from immunoglobulin G, or a heterologous signal sequence. The fusion proteins can contain additional components, such as E. coli maltose binding protein (MBP) that aid in uptake of the protein by cells (see, International PCT application No. WO 01/32711).

A protease fusion protein can be produced by standard recombinant techniques. For example, DNA fragments coding for the different polypeptide sequences can be ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel et al. (eds.) CURRENT PROTOCOLS IN MOLECULAR BIOLOGY, John Wiley & Sons, 1992). Moreover, many expression vectors are commercially available that already encode a fusion moiety (e.g., a GST polypeptide). A protease-encoding nucleic acid can be cloned into such an expression vector such that the fusion moiety is linked in-frame to the protease protein.

5. Nucleotide Sequences

Nucleic acid molecules encoding scaffold or modified proteases are provided herein. Nucleic acid molecules include allelic variants or splice variants of any encoded scaffold protease, or catalytically active portion thereof. In one embodiment, nucleic acid molecules provided herein have at least 50, 60, 65, 70, 75, 80, 85, 90, 91, 92, 93, 94, 95, or 99% sequence identity or hybridize under conditions of medium or high stringency along at least 70% of the full-length of any nucleic acid encoded scaffold protease, or catalytically active portion thereof. In another embodiment, a nucleic acid molecule can include those with degenerate codon sequences of any of the scaffold proteases or catalytically active portions thereof such as those provided herein. Exemplary nucleic acid molecules, encoding scaffold or modified proteases, or catalytically active portions thereof, have a sequence of nucleotides as set forth in any of SEQ ID NOS: 11, 13, 15, 17, 19, 21, 23, 25, 27, 29, 31, 33, 35, 37, 39, 451-523, and 534-543.

Nucleic acid molecules, or fusion proteins containing a catalytically active portion of a nucleic acid molecule, operably-linked to a promoter, such as an inducible promoter for expression in mammalian cells also are provided. Such promoters include, but are not limited to, CMV and SV40 promoters; adenovirus promoters, such as the E2 gene promoter, which is responsive to the HPV E7 oncoprotein; a PV promoter, such as the PBV p89 promoter that is responsive to the PV E2 protein; and other promoters that are activated by the HIV or PV or oncogenes.

Scaffold or modified proteases provided herein, also can be delivered to the cells in gene transfer vectors. The transfer vectors also can encode additional other therapeutic agent(s) for treatment of the disease or disorder, such as Rheumatoid Arthritis or cardiovascular disease, for which the protease is administered. Transfer vectors encoding a protease can be used systemically, by administering the nucleic acid to a subject. For example, the transfer vector can be a viral vector, such as an adenovirus vector. Vectors encoding a protease also can be incorporated into stem cells and such stem cells administered to a subject such as by transplanting or engrafting the stem cells at sites for therapy. For example, mesenchymal stem cells (MSCs) can be engineered to express a protease and such MSCs engrafted at a tumor site for therapy.

G. METHODS OF USING: FORMULATION/PACKAGING/ADMINISTRATION

Pharmaceutical compositions containing a protease or modified protease produced herein, including MT-SP1 (modified) polypeptides, modified protease fusion proteins or encoding nucleic acid molecules, can be formulated in any conventional manner by mixing a selected amount of the polypeptide with one or more physiologically acceptable carriers or excipients. Selection of the carrier or excipient is within the skill of the administering profession and can depend upon a number of parameters. These include, for example, the mode of administration (i.e., systemic, oral, nasal, pulmonary, local, topical or any other mode) and disorder treated. The pharmaceutical compositions provided herein can be formulated for single dosage (direct) administration or for dilution or other modification. The concentrations of the compounds in the formulations are effective for delivery of an amount, upon administration, that is effective for the intended treatment. Typically, the compositions are formulated for single dosage administration. To formulate a composition, the weight fraction of a compound or mixture thereof is dissolved, suspended, dispersed or otherwise mixed in a selected vehicle at an effective concentration such that the treated condition is relieved or ameliorated. Pharmaceutical carriers or vehicles suitable for administration of the compounds provided herein include any such carriers known to those skilled in the art to be suitable for the particular mode of administration.

1. Administration of Modified Protease Polypeptides

The polypeptides can be formulated as the sole pharmaceutically active ingredient in the composition or can be combined with other active ingredients. The polypeptides can be targeted for delivery, such as by conjugation to a targeting agent, such as an antibody. Liposomal suspensions, including tissue-targeted liposomes, also can be suitable as pharmaceutically acceptable carriers. These can be prepared according to methods known to those skilled in the art. For example, liposome formulations can be prepared as described in U.S. Pat. No. 4,522,811. Liposomal delivery also can include slow release formulations, including pharmaceutical matrices such as collagen gels and liposomes modified with fibronectin (see, for example, Weiner et al. (1985) *J Pharm Sci.* 74(9): 922-5).

The active compound is included in the pharmaceutically acceptable carrier in an amount sufficient to exert a therapeutically useful effect in the absence of undesirable side effects on the subject treated. The therapeutically effective concentration can be determined empirically by testing the compounds in known in vitro and in vivo systems, such as the assays provided herein.

The polypeptides provided herein (i.e. active compounds) can be administered in vitro, ex vivo, or in vivo by contacting a mixture, such as a body fluid or other tissue sample, with a protease polypeptide provided herein, including any of the modified MT-SP1 proteases provided herein. For example, when administering a compound ex vivo, a body fluid or tissue sample from a subject can be contacted with the protease polypeptides that are coated on a tube or filter, such as for example, a tube or filter in a bypass machine. When administering in vivo, the active compounds can be administered by any appropriate route, for example, orally, nasally, pulmonary, parenterally, intravenously, intradermally, subcutaneously, or topically, in liquid, semi-liquid or solid form and are formulated in a manner suitable for each route of administration.

The modified protease and physiologically acceptable salts and solvates can be formulated for administration by inhalation (either through the mouth or the nose), oral, transdermal, pulmonary, parenteral or rectal administration. For administration by inhalation, the modified protease can be delivered in the form of an aerosol spray presentation from pressurized packs or a nebulizer with the use of a suitable propellant, e.g., dichlorodifluoromethane, trichlorofluoromethane, dichlorotetrafluoroethane, carbon dioxide or other suitable gas. In the case of a pressurized aerosol, the dosage unit can be determined by providing a valve to deliver a metered amount. Capsules and cartridges of e.g., gelatin for use in an inhaler or insufflator, can be formulated containing a powder mix of a therapeutic compound and a suitable powder base such as lactose or starch.

For pulmonary administration to the lungs, the modified protease can be delivered in the form of an aerosol spray presentation from a nebulizer, turbonebulizer, or microprocessor-controlled metered dose oral inhaler with the use of a suitable propellant. Generally, particle size of the aerosol is small, such as in the range of 0.5 to 5 microns. In the case of a pharmaceutical composition formulated for pulmonary administration, detergent surfactants are not typically used. Pulmonary drug delivery is a promising non-invasive method of systemic administration. The lungs represent an attractive route for drug delivery, mainly due to the high surface area for absorption, thin alveolar epithelium, extensive vascularization, lack of hepatic first-pass metabolism, and relatively low metabolic activity.

For oral administration, the pharmaceutical compositions can take the form of, for example, tablets, pills, liquid suspensions, or capsules prepared by conventional means with pharmaceutically acceptable excipients such as binding agents (e.g., pregelatinized maize starch, polyvinylpyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets can be coated by methods well known in the art. Liquid preparations for oral administration can take the form of, for example, solutions, syrups or suspensions, or they can be presented as a dry product for constitution with water or other suitable vehicle before use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, ethyl alcohol or fractionated vegetable oils); and preservatives (e.g., methyl or propyl-p-hydroxybenzoates or sorbic acid). The preparations also can contain buffer salts, flavoring, coloring and sweetening agents as appropriate.

Preparations for oral administration can be formulated for controlled release of the active compound. For buccal administration the compositions can take the form of tablets or lozenges formulated in conventional manner.

The modified protease polypeptides can be formulated as a depot preparation. Such long-acting formulations can be administered by implantation (for example, subcutaneously or intramuscularly) or by intramuscular injection. Thus, for example, the therapeutic compounds can be formulated with suitable polymeric or hydrophobic materials (for example as an emulsion in an acceptable oil) or ion exchange resins, or as sparingly soluble derivatives, for example, as a sparingly soluble salt.

The modified protease can be formulated for parenteral administration by injection (e.g., by bolus injection or continuous infusion). Formulations for injection can be presented in unit dosage form (e.g., in ampoules or in multi-dose containers) with an added preservative. The compositions can take such forms as suspensions, solutions or emulsions in oily or aqueous vehicles and can contain formulatory agents such as suspending, stabilizing and/or dispersing agents. Alternatively, the active ingredient can be in powder-lyophilized form for constitution with a suitable vehicle, e.g., sterile pyrogen-free water, before use.

The pharmaceutical compositions can be formulated for local or topical application, such as for topical application to the skin (transdermal) and mucous membranes, such as in the eye, in the form of gels, creams, and lotions and for application to the eye or for intracisternal or intraspinal application. Such solutions, particularly those intended for ophthalmic use, can be formulated as 0.01%-10% isotonic solutions and pH about 5-7 with appropriate salts. The compounds can be formulated as aerosols for topical application, such as by inhalation (see, for example, U.S. Pat. Nos. 4,044,126, 4,414,209 and 4,364,923, which describe aerosols for delivery of a steroid useful for treatment inflammatory diseases, particularly asthma).

The concentration of active compound in the drug composition depends on absorption, inactivation and excretion rates of the active compound, the dosage schedule, and amount administered as well as other factors known to those of skill in the art. As described further herein, dosages can be determined empirically using comparisons of properties and activities (e.g., cleavage of one or more complement proteins) of the modified protease compared to the unmodified and/or native protease.

The compositions, if desired, can be presented in a package, in a kit or dispenser device, that can contain one or more unit dosage forms containing the active ingredient. In some examples, the composition can be coated on a device, such as for example on a tube or filter in, for example, a bypass machine. The package, for example, contains metal or plastic foil, such as a blister pack. The pack or dispenser device can be accompanied by instructions for administration. The compositions containing the active agents can be packaged as articles of manufacture containing packaging material, an agent provided herein, and a label that indicates the disorder for which the agent is provided.

Also provided are compositions of nucleic acid molecules encoding the protease polypeptides and expression vectors encoding them that are suitable for gene therapy. Rather than deliver the protein, nucleic acid can be administered in vivo, such as systemically or by other route, or ex vivo, such as by removal of cells, including lymphocytes, introduction of the nucleic therein, and reintroduction into the host or a compatible recipient.

2. Administration of Nucleic Acids Encoding Modified Protease Polypeptides (Gene Therapy)

Protease polypeptides can be delivered to cells and tissues by expression of nucleic acid molecules. Protease polypeptides can be administered as nucleic acid molecules encoding protease polypeptides, including ex vivo techniques and direct in vivo expression. Nucleic acids can be delivered to cells and tissues by any method known to those of skill in the art. The isolated nucleic acid can be incorporated into vectors for further manipulation. Exemplary nucleic acids are any that encode or that hybridize under medium to high stringency to a nucleic acid that encodes a scaffold or modified protease, or catalytically active portion thereof having a sequence of amino acids set forth in any of SEQ ID NOS: 12, 14, 16, 18, 20, 22, 24, 26, 28, 30, 32, 34, 36, 38, 40-69, 404-418, 419-447, 524-533, 552-659, or 663-710. Exemplary nucleic acid molecules, encoding scaffold or modified proteases, or catalytically active portions thereof, have a sequence of nucleotides as set forth in any of SEQ ID NOS: 11, 13, 15, 17, 19, 21, 23, 25, 27, 29, 31, 33, 35, 37, 39, 451-523, and 534-543.

Methods for administering protease polypeptides by expression of encoding nucleic acid molecules include administration of recombinant vectors. The vector can be designed to remain episomal, such as by inclusion of an origin of replication or can be designed to integrate into a chromosome in the cell. Protease polypeptides also can be used in ex vivo gene expression therapy using vectors. For example, cells can be engineered to express a protease polypeptide, such as by integrating a protease polypeptide encoding-nucleic acid into a genomic location, either operatively linked to regulatory sequences or such that it is placed operatively linked to regulatory sequences in a genomic location. Such cells then can be administered locally or systemically to a subject, such as a patient in need of treatment. Exemplary vectors for in vivo and ex vivo gene therapy include viral vectors, and non-viral vectors such as for example, liposomes or artificial chromosomes.

Viral vectors, including, for example adenoviruses, herpes viruses, retroviruses EBV, SV40, cytomegalovirus vector, vaccinia virus vector, and others designed for gene therapy can be employed. The vectors can remain episomal or can integrate into chromosomes of the treated subject. A protease polypeptide can be expressed by a virus, which is administered to a subject in need of treatment. Virus vectors suitable for gene therapy include adenovirus, adeno-associated virus, retroviruses, lentiviruses and others noted above. For example, adenovirus expression technology is well-known in the art and adenovirus production and administration methods also are well known. Adenovirus serotypes are available, for example, from the American Type Culture Collection (ATCC, Rockville, Md.). Adenovirus can be used ex vivo, for example, cells are isolated from a patient in need of treatment, and transduced with a protease polypeptide-expressing adenovirus vector. After a suitable culturing period, the transduced cells are administered to a subject, locally and/or systemically. Alternatively, protease polypeptide-expressing adenovirus particles are isolated and formulated in a pharmaceutically-acceptable carrier for delivery of a therapeutically effective amount to prevent, treat or ameliorate a disease or condition of a subject. In one embodiment, the disease to be treated is caused by complement activation. Typically, adenovirus particles are delivered at a dose ranging from 1 particle to 1014 particles per kilogram subject weight, generally between 106 or 108 particles to 1012 particles per kilogram subject weight.

The nucleic acid molecules can be introduced into artificial chromosomes and other non-viral vectors. Artificial chromosomes, such as ACES (see, Lindenbaum et al. *Nucleic Acids Res.* 2004 Dec. 7; 32(21):e172) can be engineered to encode and express the protease or modified protease. Briefly, mammalian artificial chromosomes (MACs) provide a means to introduce large payloads of genetic information into the cell in an autonomously replicating, non-integrating format. Unique among MACs, the mammalian satellite DNA-based Artificial Chromosome Expression System (ACES) can be reproducibly generated de novo in cell lines of different species and readily purified from the host cells' chromosomes. Purified mammalian ACEs can then be re-introduced into a variety of recipient cell lines where they have been stably maintained for extended periods in the absence of selective pressure using an ACE System. Using this approach, specific loading of one or two gene targets has been achieved in LMTK(−) and CHO cells.

Another method for introducing nucleic acids encoding the modified protease polypeptides is a two-step gene replacement technique in yeast, starting with a complete adenovirus genome (Ad2; Ketner et al. (1994) *Proc. Natl. Acad. Sci. USA* 91: 6186-6190) cloned in a Yeast Artificial Chromosome (YAC) and a plasmid containing adenovirus sequences to target a specific region in the YAC clone, an expression cassette for the gene of interest and a positive and negative selectable marker. YACs are of particular interest because they permit incorporation of larger genes. This approach can be used for construction of adenovirus-based vectors bearing nucleic acids encoding any of the described modified protease polypeptides for gene transfer to mammalian cells or whole animals.

The nucleic acids can be encapsulated in a vehicle, such as a liposome, or introduced into a cells, such as a bacterial cell, particularly an attenuated bacterium or introduced into a viral vector. For example, when liposomes are employed, proteins that bind to a cell surface membrane protein associated with endocytosis can be used for targeting and/or to facilitate uptake, e.g., capsid proteins or fragments thereof tropic for a particular cell type, antibodies for proteins which undergo internalization in cycling, and proteins that target intracellular localization and enhance intracellular half-life.

In some situations it is desirable to provide a nucleic acid source with an agent that targets cells, such as an antibody specific for a cell surface membrane protein or a target cell, or a ligand for a receptor on a target cell. Polynucleotides and expression vectors provided herein can be made by any suitable method. Further provided are nucleic acid vectors containing nucleic acid molecules as described above. Further provided are nucleic acid vectors containing nucleic acid molecules as described above and cells containing these vectors.

For ex vivo and in vivo methods, nucleic acid molecules encoding the protease polypeptide are introduced into cells that are from a suitable donor or the subject to be treated. Cells into which a nucleic acid can be introduced for purposes of therapy include, for example, any desired, available cell type appropriate for the disease or condition to be treated including, but not limited to, epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, in particular hematopoietic stem or progenitor cells, e.g., such as stem cells obtained from bone marrow, umbilical cord blood, peripheral blood, fetal liver, and other sources thereof.

For ex vivo treatment, cells from a donor compatible with the subject to be treated or cells from a subject to be treated are removed, the nucleic acid is introduced into these isolated cells and the modified cells are administered to the subject. Treatment includes direct administration, such as, for example, encapsulated within porous membranes, which are implanted into the patient (see, e.g., U.S. Pat. Nos. 4,892,538 and 5,283,187). Techniques suitable for the transfer of nucleic acid into mammalian cells in vitro include the use of liposomes and cationic lipids (e.g., DOTMA, DOPE and DC-Chol) electroporation, microinjection, cell fusion, DEAE-dextran, and calcium phosphate precipitation methods. Methods of DNA delivery can be used to express protease polypeptides in vivo. Such methods include liposome delivery of nucleic acids and naked DNA delivery, including local and systemic delivery such as using electroporation, ultrasound and calcium-phosphate delivery. Other techniques include microinjection, cell fusion, chromosome-mediated gene transfer, microcell-mediated gene transfer and spheroplast fusion.

In vivo expression of a protease polypeptide can be linked to expression of additional molecules. For example, expression of a protease polypeptide can be linked with expression of a cytotoxic product such as in an engineered virus or expressed in a cytotoxic virus. Such viruses can be targeted to a particular cell type that is a target for a therapeutic effect. The expressed protease polypeptide can be used to enhance the cytotoxicity of the virus.

In vivo expression of a protease polypeptide can include operatively linking a protease polypeptide encoding nucleic acid molecule to specific regulatory sequences such as a cell-specific or tissue-specific promoter. Protease polypeptides also can be expressed from vectors that specifically infect and/or replicate in target cell types and/or tissues. Inducible promoters can be use to selectively regulate protease polypeptide expression.

Nucleic acid molecules, as naked nucleic acids or in vectors, artificial chromosomes, liposomes and other vehicles can be administered to the subject by systemic administration, topical, local and other routes of administration. When systemic and in vivo, the nucleic acid molecule or vehicle containing the nucleic acid molecule can be targeted to a cell.

Administration also can be direct, such as by administration of a vector or cells that typically targets a cell or tissue. For example, tumor cells and proliferating cells can be targeted cells for in vivo expression of protease polypeptides. Cells used for in vivo expression of a protease polypeptide also include cells autologous to the patient. Such cells can be removed from a patient, nucleic acids for expression of a protease polypeptide introduced, and then administered to a patient such as by injection or engraftment.

H. THERAPEUTIC USES

Therapeutic proteases have many potential advantages over traditional therapeutic approaches. Chief among them is the ability to inactivate disease targets in a catalytic manner (i.e. a one to many stoichiometry). Additional differentiating advantages include (1) irreversible inactivation; (2) low dosing; (3) small molecular size; (4) the ability to target post-translational modifications; (5) the ability to neutralize high target concentrations; and (6) the ability to target away from the active site. As a therapeutic, a protease must still exhibit the following characteristics: (1) access to the molecular target (extracellular), and (2) possess sufficiently stringent specificity for a target critical to a disease state. The protease polypeptides provided herein can be used in the treatment of diseases.

The protease polypeptides and nucleic acid molecules provided herein can be used for treatment of any condition for which activation of the complement pathway is implicated, particularly inflammatory conditions including acute inflammatory conditions, such as septic shock, and chronic inflammatory conditions, such as Rheumatoid Arthritis (RA). Acute and inflammatory conditions can be manifested as an immune-mediated disease such as for example autoimmune disease or tissue injury caused by immune-complex-mediated inflammation. A complement-mediated inflammatory condition also can be manifested as a neurodegenerative or cardiovascular disease that has inflammatory components. This section provides exemplary uses of, and administration methods for, proteases. These described therapies are exemplary and do not limit the applications of proteases. Such methods include, but are not limited to, methods of treatment of physiological and medical conditions described and listed below. Such methods include, but are not limited to, methods of treatment of sepsis, Rheumatoid arthritis (RA), membranoproliferative glomerulonephritis (MPGN), lupus erythematosus, Multiple Sclerosis (MS), Myasthenia gravis (MG), asthma, inflammatory bowel disease, respiratory distress syndrome, immune complex (IC)-mediated acute inflammatory tissue injury, multiorgan failure, Alzheimer's Disease (AD), Ischemia-reperfusion injuries caused by events or treatments such as myocardial infarct (MI), stroke, cardiopulmonary bypass (CPB) or coronary artery bypass graft, angioplasty, or hemodialysis, or Guillan Barre syndrome.

Treatment of diseases and conditions with proteases can be effected by any suitable route of administration using suitable formulations as described herein including, but not limited to, subcutaneous injection, oral and transdermal administration. If necessary, a particular dosage and duration and treatment protocol can be empirically determined or extrapolated. For example, exemplary doses of recombinant and native protease polypeptides can be used as a starting point to determine appropriate dosages. Modified proteases that have more specificity and/or selectivity compared to a wildtype or scaffold protease can be effective at reduced dosage amounts and or frequencies. Dosage levels can be determined based on a variety of factors, such as body weight of the individual, general health, age, the activity of the specific compound employed, sex, diet, time of administration, rate of excretion, drug combination, the severity and course of the disease, and the patient's disposition to the disease and the judgment of the treating physician. The amount of active ingredient that can be combined with the carrier materials to produce a single dosage form will vary depending upon the host treated and the particular mode of administration.

Upon improvement of a patient's condition, a maintenance dose of a compound or compositions can be administered, if necessary; and the dosage, the dosage form, or frequency of administration, or a combination thereof can be modified. In some cases, a subject can require intermittent treatment on a long-term basis upon any recurrence of disease symptoms.

1. Immune-Mediated Inflammatory Diseases

Proteases and modified proteases described herein, including but not limited to modified MT-SP1 proteases, can be used to treat inflammatory diseases. Inflammatory diseases that can be treated with proteases include acute and chronic inflammatory diseases. Exemplary inflammatory diseases include central nervous system diseases (CNS), autoimmune diseases, airway hyper-responsiveness conditions such as in asthma, rheumatoid arthritis, inflammatory bowel disease, and immune complex (IC)-mediated acute inflammatory tissue injury.

Experimental autoimmune encephalomyelitis (EAE) can serve as a model for multiple sclerosis (MS) (Piddlesden et al., (1994) *J Immunol* 152:5477). EAE can be induced in a number of genetically susceptible species by immunization with myelin and myelin components such as myelin basic protein, proteolipid protein and myelin oligodendrocyte glycoprotein (MOG). For example, MOG-induced EAE recapitulates essential features of human MS including the chronic, relapsing clinical disease course, and the pathohistological triad of inflammation, reactive gliosis, and the formation of large confluent demyelinated plaques. Proteases and modified proteases can be assessed in EAE animal models. Proteases are administered, such as by daily intraperitoneal injection, and the course and progression of symptoms is monitored compared to control animals. The levels of inflammatory complement components that can exacerbate the disease also can be measured by assaying serum complement activity in a hemolytic assay and by assaying for the deposition of complement components, such as for example C1, C3 and C9.

Complement activation modulates inflammation in diseases such as rheumatoid arthritis (RA) (Wang et al., (1995) *PNAS* 92:8955). Proteases and modified proteases, including modified MT-SP1 polypeptides, can be used to treat RA. For example, proteases can be injected locally or systemically. Proteases can be dosed daily or weekly. PEGylated proteases can be used to reduce immunogenicity. In one example, type II collagen-induced arthritis (CIA) can be induced in mice as a model of autoimmune inflammatory joint disease that is histologically similar to RA characterized by inflammatory synovitis, pannus formation, and erosion of cartilage and bone. To induce CIA, bovine type II collagen (B-CII) in the presence of complete Freund's adjuvant can be injected intradermally at the base of the tail. After 21 days, mice can be reimmunized using the identical protocol. To examine the effects of a protease or modified protease, including MT-SP1 polypeptides, 3 weeks following the initial challenge with B-CII, a protease or control can be administered intraperitoneally twice weekly for 3 weeks. Mice can be sacrificed 7 weeks following the initial immunization for histologic analysis. To assess the therapeutic affect of a protease on established disease, a protease can be administered daily for a total of 10 days following the onset of clinical arthritis in one or more limbs. The degree of swelling in the initially affected joints can be monitored by measuring paw thickness using calipers. In both models, serum can be drawn from mice for hemolytic assays and measurement of complement markers of activation such as for example C5a and C5b-9. In another example, primate models are available for RA treatments. Response of tender and swollen joints can be monitored in subjects treated with protease polypeptides and controls to assess protease treatment.

Proteases or modified proteases, including but not limited to MT-SP1 polypeptides, can be used to treat immune complex (IC)-mediated acute inflammatory tissue injury. IC-mediated injury is caused by a local inflammatory response against IC deposition in a tissue. The ensuing inflammatory response is characterized by edema, neutrophila, hemorrhage, and finally tissue necrosis. IC-mediated tissue injury can be studied in an in vivo Arthus (RPA) reaction. Briefly, in the RPA reaction, an excess of antibody (such as for example rabbit IgG anti-chicken egg albumin) is injected into the skin of animals, such as for example rats or guinea pigs, that have previously been infused intravenously with the corresponding antigen (i.e. chicken egg albumin) (Szalai et al., (2000) *J Immunol* 164:463). Immediately before the initiation on an RPA reaction, a protease, or a bolus control, can be administered at the same time as the corresponding antigen by an intravenous injection via the right femoral vein. Alternatively, a protease can be administered during the initial hour of the RPA reaction, beginning immediately after injection of the antigen and just before dermal injection of the antibody. The effects of a protease on the generation of complement-dependent IC-mediated tissue injury can be assessed at various times after initiation of RPA by collecting blood to determine the serum hemolytic activity, and by harvesting the infected area of the skin for quantitation of lesion size.

Therapeutic proteases, such as those described herein including MT-SP1 polypeptides, can be used to treat sepsis and severe sepsis that can result in lethal shock. A model of complement-mediated lethal shock can be used to test the effects of a protease as a therapeutic agent. In one such example, rats can be primed with a trace amount of lipopolysaccharide (LPS), followed by the administration of a monoclonal antibody against a membrane inhibitor of complement (anti-Crry) (Mizuno M et al., (2002) *Int Arch Allergy Immunol* 127:55). A protease or control can be administered at any time during the course of initiation of lethal shock such as before LPS priming, after LPS priming, or after anti-Crry administration and the rescue of rats from lethal shock can be assessed.

2. Neurodegenerative Disease

Complement activation exacerbates the progression of Alzheimer's disease (AD) and contributes to neurite loss in AD brains. Proteases and modified proteases described herein, including but not limited to modified MT-SP1 polypeptides, can be used to treat AD. Mouse models that mimic some of the neuropathological and behavioral features of AD can be used to assess the therapeutic effects of proteases. Examples of transgenic mouse models include introducing the human amyloid precursor protein (APP) or the presenilin 1 (PS1) protein with disease-producing mutations into mice under the control of an aggressive promoter. These mice develop characteristics of AD including increases in beta-amyloid plaques and dystrophic neurites. Double transgenic mice for APP and PS1 mutant proteins develop larger numbers of fibrillar beta-amyloid plaques and show activated glia and complement factors associated with the plaque. Proteases can be administered, such as by daily intraperitoneal or intravenous injections, and the course and progression of symptoms is monitored compared to control animals.

3. Cardiovascular Disease

Proteases and modified proteases described herein, including but not limited to modified MT-SP1 proteases, can be used to treat cardiovascular disease. Proteases can be used in the treatment of cardiovascular diseases including ischemia reperfusion injury resulting from stroke, myocardial infarction, cardiopulmonary bypass, coronary artery bypass graft, angioplasty, or hemodialysis. Proteases also can be used in the treatment of the inflammatory response associated with cardiopulmonary bypass that can contribute to tissue injury. Generally, a protease can be administered prior to, concomitantly with, or subsequent to a treatment or event that induces a complement-mediated ischemia reperfusion injury. In one example, a protease can be administered to a subject prior to the treatment of a subject by a complement-mediated, ischemic-injury inducing event, such as for example coronary artery bypass graft of angioplasty.

Effects of a protease on treatment of ischemia reperfusion injury can be assessed in animal models of the injury. In one such model, myocardial ischemia is induced in rabbits that have had an incision made in their anterior pericardium by placing a 3-0 silk suture around the left anterior descending (LAD) coronary artery 5-8 mm from its origin and tightening the ligature so that the vessel becomes completely occluded (Buerke et al., (2001) *J Immunol* 167:5375). A protease, such as for example a modified MT-SP1 polypeptide, or a control vehicle such as saline, can be given intravenously in increasing doses as a bolus 55 minutes after the coronary occlusion (i.e. 5 minutes before reperfusion). Five minutes later (i.e. after a total of 60 minutes of ischemia) the LAD ligature can be untied and the ischemic myocardium can be reperfused for 3 hours. At the end of the reperfusion period, the ligature around the LAD is tightened. Effects of a protease on ischemia injury can be analyzed by assessing effects on myocardial necrosis, plasma creatine kinase levels, and markers of neutrophil activation such as for example myeloperoxidase activity and superoxide radical release.

In another model of complement-mediated myocardial injury sustained upon perfusion of isolated mouse hearts with Krebs-Henseleit buffer containing 6% human plasma, treatment with proteases or modified proteases can be used to limit tissue damage to the heart. In such an example, the buffer used to perfuse the hearts can be supplemented with varying doses of proteases, such as but not limited to modified proteases including MT-SP1 polypeptides. The perfused hearts can be assayed for deposition of human C3 and C5b-9, coronary artery perfusion pressure, end-diastolic pressure, and heart rate.

Proteases and modified proteases, such as for example MT-SP1 polypeptides, can be used as therapeutics prior to or following Cardiopulmonary Bypass (CPB) or coronary artery bypass graft to inhibit the inflammatory immune response that often follows bypass and that can contribute to tissue injury. An in vitro recirculation of whole blood in an extracorporeal bypass circuit can be used to stimulate platelet and leukocyte changes and complement activation induced by CPB (Rinder et al. (1995) *J. Clin. Invest.* 96:1564). In such a model, addition of a protease or modified protease or control buffer, in varying doses, can be added to a transfer pack already containing blood from a healthy donor and porcine heparin, just prior to addition of the blood to the extracorporeal circuit. Blood samples can be drawn at 5, 15, 30, 45, 60, 75, and 90 minutes after recirculation and assayed for complement studies such as for example hemolytic assays and/or complement activation assays to measure for C5a, C3a, and/or sC5b-9. A pretreatment sample of blood drawn before its addition to the extracorporeal circuit can be used as a control. Flow cytometry of blood samples can be performed to determine levels of adhesion molecules on populations of circulating leukocytes (i.e. neutrophils) in the blood such as for example CD11b and P-selectin levels.

I. COMBINATION THERAPIES

Wildtype and modified proteases can be used in combination with each other and with other existing drugs and therapeutic agents to treat diseases and conditions. For example, as described herein a number of proteases can be used to treat acute and chronic inflammatory conditions and diseases. Such treatments can be performed in conjunction with other anti-inflammatory drugs and/or therapeutic agents. Examples of anti-inflammatory drugs and agents useful for combination therapies include non steroidal anti-inflammatory drugs (NSAIDs) including salicylates, such as aspirin, traditional NSAIDs such as ibuprofen, naproxen, ketoprofen, nabumetone, piroxicam, diclofenac, or indomethacin, and Cox-2 selective inhibitors such as celecoxib (Celebrex®) or Rotecoxin (Vioxx®). Other compounds useful in combination therapies include antimetabolites such as methotrexate and leflunomide, corticosteroids or other steroids such as cortisone, dexamethasone, or prednisone, analgesics such as acetaminophen, aminosalicylates such as mesalamine, and cytotoxic agents such as azathioprine (Imuran®), cyclophosphamide (Cytoxan®), and cyclosporine A. Additional agents that can be used in combination therapies include biological response modifiers. Biological response modifiers can include pro-inflammatory cytokine inhibitors including inhibitors of TNF-alpha such as etanercept (Enbrel®), infliximab (Remicade®), or adalimumad (Humira®), and inhibitors of IL-1 such as anakinra (Kineret®). Biological response modifiers also can include anti-inflammatory cytokines such as IL-10, B cell targeting agents such as anti-CD20 antibodies (Rituxmab®), compounds targeting T antigens, adhesion molecule blockers, chemokines receptor antagonists, kinase inhibitors such as inhibitors to MAP Kinase, JNK, or NFκB, and PPAR-γ ligands.

Wildtype and modified proteases also can be used in combination with agents that are administered to treat cardiovascular disease and/or administered during procedures to treat cardiovascular disease such as for example those described herein that contribute to inflammatory conditions associated with complement-mediated ischemia-reperfusion injury. For example, proteases provided herein such as scaffold proteases or modified proteases can be administered in combination with anti-coagulants. Examples of exemplary anti-coagulants include, but are not limited to, heparin, warfarin, acenocoumarol, phenindione, EDTA, citrate, oxalate, and direct thrombin inhibitors such as argatroban, lepirudin, bivalirudin, ximelagatran.

Additional agents, such as other complement inhibitors, can be used as anti-inflammatory drugs in combination therapy with proteases and modified proteases as described herein. Examples of such other complement inhibitors include cobra venom factor (CVF), polyanionic molecules such as heparin, dextran sulphate, polyvinyl sulphate, polylysine, or suramin, natural molecules such as K-76COOH, Rosmarinic acid, or extract of the Chinese medicinal herb Ephedra, synthetic molecules such as afamastat mesilate (FUT-175), a synthetic inhibitor of C1s (C1s-INH-248), or an inhibitor against C1s and fD (BCX-1470), peptide inhibitors such as compstatin, antibody inhibitors of complement such as anti-C5 (N19-8), a humanized anti-C5 (h5G1.1), anti-C6, or anti-C8 antibodies, and soluble forms of membrane complement regulators such as soluble CR1 (sCR1), soluble DAF (sDAF), soluble MCP (sMCF), or soluble CD59 (sCD59) (Morgan et al., (2003) *Mol. Immunol.* 40:159).

Pharmaceutical compositions containing a protease or modified protease described herein can be used to treat any one or more inflammatory diseases or conditions mediated by complement activation. Also provided are combinations of a protease or modified protease and another treatment or compound for treatment of an inflammatory disease or condition. The protease or modified protease and the anti-inflammatory agent can be packaged as separate compositions for administration together or sequentially or intermittently. Alternatively, they can provided as a single composition for administration or as two compositions for administration as a single composition. The combinations can be packaged as kits, optionally with additional reagents, instructions for use, vials and other containers, syringes and other items for use of the modified protease.

J. EXAMPLES

The following examples are included for illustrative purposes only and are not intended to limit the scope of the embodiments provided herein.

Example 1

Cloning and Mutagenesis of MT-SP1

Wildtype MT-SP1 was cloned into the pQE32 bacterial expression vector (Qiagen, SEQ ID NO:345) C-terminal to the 6 histidine tag using the BamH1 and HindIII restriction sites. The construct included pro-region, activation sequence, and protease domain, and contained residues 598 to the C-terminus of the sequence published by Takeuchi et al. (1999) *PNAS* 96:11054 and SEQ ID NO:2 (i.e. corresponding to residues 598 to 855 of the sequence of amino acids set forth in SEQ ID NO:2). Mutants were generated by the Quikchange site directed mutagenesis (Stratagene). Briefly, a PCR sample reaction was set up containing the wildtype MT-SP1 as a template and oligonucleotide primers designed to contain the desired mutation (see Table 21). The PCR reaction was as follows in a 50 μl total reaction volume: 5 μl 10× Reaction Buffer, 1 μl MT-SP1 DNA template (100 ng/μl), 0.5 μl 50 μM forward Primer, 0.5 μl 50 μM reverse Primer, 1.0 μl dNTPs, 41.0 μl H$_2$O, and 1.0 μl Pfu Ultra (2.5 units/μl). A control reaction also was performed in the absence of forward or reverse Primers. The PCR reaction conditions were as follows: 95° C. for 30 sec, followed by 18 cycles at 95° C. for 30 s, 55° C. for 60 s, and 72° C. for 8 min, 24 s. The reaction was terminated with an elongation step at 72° C. for 10 min followed by incubation at 4° C. Each reaction product was digested with DpnI for 1-2 hours at 37° C. 1.0 ml of the products were transformed into XL-1 Blue Supercompetent cells and plated at 2.0 μl and 20.0 μl on selective agar containing 50 μg/ml carbenicillin.

TABLE 21

Mutagenesis Primers

| Primer | Sequence | SEQ ID NO |
|---|---|---|
| F97Dforward | 5'-CACCCCTTCTTCAATGACGACACCTTCGACTATGACATCG-3' | 346 |
| F97Dreverse | 5'-CGATGTCATAGTCGAAGGTGTCGTCATTGAAGAAGGGGTG-3' | 347 |
| F97Eforward | 5'-CCACCCCTTCTTCAATGACGAGACCTTCGACTATGACATCGC-3' | 348 |
| F97Ereverse | 5'-GCGATGTCATAGTCGAAGGTCTCGTCATTGAAGAAGGGGTGG-3' | 349 |
| F97Aforward | 5'-CACCCCTTCTTCAATGACGCCACCTTCGACTATGACATC-3' | 350 |
| F97Areverse | 5'-GATGTCATAGTCGAAGGTGGCGTCATTGAAGAAGGGGTG-3' | 351 |
| F97Wforward | 5'-CACCCCTTCTTCAATGACTGGACCTTCGACTATGACATC-3' | 352 |
| F97Wreverse | 5'-GATGTCATAGTCGAAGGTCCAGTCATTGAAGAAGGGGTG-3' | 353 |
| Y146Nforward | 5'-GGACACACCCAGAACGGAGGCACTGGC-3' | 354 |
| Y146Nreverse | 5'-GCCAGTGCCTCCGTTCTGGGTGTGTCC-3' | 355 |
| Y146Dforward | 5'-GGACACACCCAGGACGGAGGCACTGGC-3' | 356 |
| Y146Dreverse | 5'-GCCAGTGCCTCCGTCCTGGGTGTGTCC-3' | 357 |
| Y146Eforward | 5'-GGGACACACCCAGGAGGGAGGCACTGGCG-3' | 358 |
| Y146Ereverse | 5'-CGCCAGTGCCTCCCTCCTGGGTGTGTCCC-3' | 359 |
| Y146Aforward | 5'-GGGACACACCCAGGCCGGAGGCACTGGCG-3' | 360 |
| Y146Areverse | 5'-CGCCAGTGCCTCCGGCCTGGGTGTGTCCC-3' | 361 |
| Y146Wforward | 5'-GGGACACACCCAGTGGGGAGGCACTGGCG-3' | 362 |
| Y146Wreverse | 5'-CGCCAGTGCCTCCCCACTGGGTGTGTCCC-3' | 363 |
| Y146Rforward | 5'-GGGGACACACCCAGAGGGGAGGCACTGGCGC-3' | 364 |
| Y146Rreverse | 5'-GCGCCAGTGCCTCCCCTCTGGGTGTGTCCCC-3' | 365 |

TABLE 21-continued

Mutagenesis Primers

| Primer | Sequence | SEQ ID NO |
|---|---|---|
| Q192Rforward | 5'-TGGACTCCTGCCGGGGTGATTCCGG-3' | 366 |
| Q192Rreverse | 5'-CCGGAATCACCCCGGCAGGAGTCCA-3' | 367 |
| K224Aforward | 5'-CGCTCAGAGGAACGCGCCAGGCGTGTACA-3' | 368 |
| K224Areverse | 5'-TGTACACGCCTGGCGCGTTCCTCTGAGCG-3' | 369 |
| K224Fforward | 5'-GCTGCGCTCAGAGGAACTTCCCAGGCGTGTACAAG-3' | 370 |
| K224Freverse | 5'-CTTGTGTACACGCCTGGGAAGTTCCTCTGAGCGCAGC-3' | 371 |

The sequences of each of the cloned protease domain MT-SP1 mutants designated by CB numbering is set forth in any of SEQ ID NOS: 10, 12, 14, 16, 18, 20, 22, 24, 26, 28, 30, 32, 34, 36, 38, 40, 552-605, and 672-680.

Example 2

Expression and Purification of MT-SP1

Wild-type and modified MT-SP1 were cloned into the pQE32 bacterial expression vector (Qiagen, SEQ ID NO:345) containing an N-terminal 6 histidine tag, prodomain, and protease domain as discussed in Example 1 above and the resulting constructs transformed into BL-21 *E. coli* cells. Cells were grown in 100 mL cultures to an OD of 0.6, and expression of the protease in inclusion bodies was induced by adding IPTG to a final concentration of 1 mM. After 4-6 hours, the bacteria were pelleted by centrifugation and the pellet resuspended in 50 mM Tris pH 8, 500 mM KCl, and 10% glycerol (buffer A). Cells were lysed by sonication and pelleted by centrifugation at 6000×g. Pellets were resuspended in 50 mM Tris pH 8, 6 M urea, 100 mM NaCl and 1% 2-mercaptoethanol (buffer B). Membrane and organelles were pelleted by centrifugation at 10,000×g and the supernatant was passed over a nickel NTA column (Qiagen). The column was washed with 50 mM Tris pH 8, 6 M urea, 100 mM NaCl, 20 mM imidazole, 1% 2-mercaptoethanol and 0.01% Tween 20 (buffer D). The column was washed again with buffer D without Tween 20. The protease was then eluted from the column with 50 mM Tris pH 8, 6 M urea, 100 mM NaCl, 1% 2-mercaptoethanol and 250 mM imidazole (buffer E). The protease was then concentrated to a volume of ~1 mL and then dialyzed at 4° C. overnight in 1 L of 50 mM Tris pH 8, 3 M urea, 100 mM NaCl, 1% 2-mercaptoethanol, and 10% glycerol. Finally, the protease was dialyzed into 50 mM Tris pH 8, 100 mM NaCl, and 10% glycerol at 4° C. overnight. During the last dialysis step, the protease becomes autoactivated by self-cleavage at the juncture between the prodomain and the protease domain at the sequence RQAR/VVGG, resulting in the removal of the 6 histidine tag and prodomain.

Example 3

Expression and Purification of Modified MT-SP1 CB155 in Shake Flasks

CB155 and related recombinant human serine protease mutants as well as the wild-type MT-SP1 protease were cloned and expressed in *E. coli* as inclusion bodies as described in Examples 1 and 2 above. The production of the MT-SP1 or mutants was adapted for laboratory scale by pooling up to 30×1 L shake flasks for subsequent isolation of the inclusion body pellets for solubilization and refolding. Briefly, the MT-SP1 mutant CB155 plasmid construct was transformed into XL-1 Blue Supercompetent cells and a single fresh colony was picked and grown in 25 ml of luria broth (LB; Difco LB Broth Lennox, approximate formulation per liter: 10.0 g Tryptone, 10.0 g Yeast Extract, 5.0 g Sodium Chloride) containing 50 µg/ml carbenecillin at 37° C. overnight. Ten milliliters of the overnight culture was diluted into 1 L of LB in an Ultra Yield Flask (2.5 L) and was shaken at 37° C. to an OD600 of about 0.6 to about 0.7 (i.e. shaken at 37° C. for about 2 hours). IPTG (Dioxane Free; Calbiochem) at 1.0 M was added to the culture at a final concentration of 1 mM to induce expression of the protease in inclusion bodies and the culture was shaken for an additional 4 hours at 37° C. The culture was harvested by centrifugation at 6000 rpm in a Sorvall rotor # SLC4000 for 20 minutes.

The cell pellet from the 1 L culture was resuspended in 50 ml of Wash Buffer II (300 mM Sodium Chloride, 50 mM Potassium Phosphate pH 7.4) and was transferred to a rosette cell for sonication. Cells were lysed by sonication as follows: 20-50 ml solution for 2 minutes, 30% duty cycle, output=5-6, on ice, repeated three times; 100+ ml solution for 2 minutes, 60% duty cycle, output=8, on ice, repeated six times. The sonicated lysate was centrifuged at 7000 rpm for 20 minutes at 4° C. Supernatant was discarded and the pellets were resuspended in 40 ml Wash Buffer I (300 mM Sodium Chloride, 50 mM Potassium Phosphate pH 7.4, 0.5% LDAO) per about 2.0 gram of inclusion bodies using a spatula and vortexing. The inclusion bodies were centrifuged at 9000 rpm for 15 minutes at 4° C., and washed a total of three times in Wash Buffer I. The centrifugation and washing steps were repeated two additional times in Wash Buffer II. The washed inclusion bodies were suspended in 20 ml of denaturing buffer (6 M Guanidine Hydrochloride, 100 mM Tris HCL pH 8.0, 20 mM Dithiothreitol) per about 2.0 grams of inclusion bodies using a spatula to break up the pellet and rocked at room temperature for 30 minutes until the pellet was dissolved or mostly dissolved. Any insoluble material was removed by centrifugation at 9000 rpm in a Sorvall SLA600TC rotor followed by resuspension in 20 ml buffer. The sample was slowly dripped into a beaker containing 100× volume of refolding buffer (100 mM Tris HCL pH 8.0, 150 mM NaCl, 5 mM reduced Glutathione, 0.05M oxidized glutathione, 1.5 M L-Arginine mono hydrochloride) and stirred slowly at 4° C. for 72 hours. The sample was diluted to 1 M final concentration of Arginine-HCL in 50 mM Tris pH 8.0/50 mM NaCl and then concentrated to about 700 ml using cross-flow filtration. The sample was then transferred to the VivaFlow (Sartorius, Edgewood N.Y.) and further concentrated to a final volume of about 300 ml. The sample was dialyzed into 50 mM Tris pH 8.0/50 mM NaCl (8 L) overnight. Some precipitation of the sample occurred. The sample was centrifuged at 9000 rpm to remove the precipitation.

The sample was incubated at room temperature until auto-activation of the protease occurred by cleavage of the proregion to release the mature enzyme. The autoactivation occurs during the purification process. Activity was monitored by SDS-PAGE (a 3 kilodalton shift). Activity also was monitored by enzyme activity as assessed by cleavage of a fluorogenic substrate. To measure enzyme activity, protease was diluted from 1:20 fold to 1:100 fold in assay buffer containing 50 mM Tris pH 8.0, 50 mM NaCl and 0.01% Tween-20. Five µl of the diluted protease was mixed with 50 µl of 100 µM Ac-RQAR-AMC substrate, and the fluorescence was measured in a fluorescence spectrophotometer (Molecular Devices Gemini XPS) at an excitation wavelength of 380 nm, an emission wavelength of 450 nm and using a cut-off filter set at 435 nm. Activity was assessed over time as the sample was allowed to incubate at room temperature for about 24 to 72 hours until the activity stabilized. For more dilute samples, more time may be needed. Typically, the protease was allowed to achieve >75% activation before purification by anion exchange.

Once activity stabilized, the sample was dialyzed into 50 mM Hepes pH 6.5 (8 L) overnight. The sample was filtered and loaded onto a SourceQ column. After loading onto the SourceQ column, the sample was washed with 3 column volumes of buffer A (50 mM Hepes pH 6.5) and eluted with a gradient from 0-20% buffer B (50 mM Hepes pH 6.5/1 M NaCl) over 10 column volumes. The activity of each fraction was measured, and active fractions were combined and dialyzed into PBS overnight. The protein sample was concentrated to about 5 ml and benzamidine was added to a final concentration of 20 mM to inhibit the autolysis of CB155. The overall yield of CB155 is typically about 15 to 20 mg CB155/1 L cell culture. A yield of 22 mg/liter cell culture has been achieved by production of CB155 at the shake flask scale. The overall yield from inclusion body to native protein was typically less than 10%. Titers in the fermentation up to 3 g/L have been achieved in shake flasks.

The purified protein was assayed for specific activity, purity, and endotoxin levels. The specific activity or amount of active protease in each prep was determined by active site titration by incubation with an inhibitor that binds in the active site of the functional protease at varying concentrations followed by addition to a fluorogenic substrate for measurement of substrate proteolysis. The amount of active enzyme was calculated from a plot of the residual protease activity against the inhibitor concentration where the intercept corresponds to the concentration of active protease. Briefly, the purified protein was titrated with ecotin M84R using the method of Harris et al. (JBC, 1988, 273:27354-73) by titrating a stock of trypsin with 4-methylumbelliferyl p-guandinobenzoate (MUGB), then titrating a stock of M84R ecotin with the trypsin, and finally titrating the purified protease with the M84R ecotin stock. In each case, the protease was incubated for 30 minutes at 30° C. with concentrations of the inhibitor between 0.1 and 2 times the expected protease concentration. Residual activities between 30% and 90% of the uninhibited protease activity were used to plot the data. Enzyme activity was monitored at 30° C. in the presence of 40 µM Ac-RQAR-AMC in assay buffer containing 50 mM Tris pH 8.0, 50 mM NaCl, and 0.01% Tween-20 (for trypsin activity, 10 mM CaCl2 was added) on a Gemini XPS spectrafluorimeter (Excitation: 380 nm; Emission: 450 nm; Cut-off: 435 nm). Purity of the protein preparation was assessed by resolution of the protein product on SDS-PAGE followed by staining with Coomassie Blue. The mature protease runs as a single band at 25 kD. The level of endotoxin in each prep was determined by *Limulus Amebocyte* Lysate Chromo-LAL assay (Associated of Cape Cod) according to the manufacturer's protocol with the following modifications. The protease was diluted 100 fold into LAL Reagent Water (LRW), and split into two tubes. A challenge of 100 endotoxin unit (EU)/mL was added to one tube and LRW to the other. Then, the sample was diluted 2 fold into stock solutions such that the reaction contained a final concentration of 5 mM tosyl-lysyl-chloromethylketone (TLCK) and 10 mM Tris pH 8.0. Each sample was incubated 2 hours at 37° C. to inactivate the protease activity. Samples were further diluted 50 fold and assayed according to the manufacturer's instructions. Results were considered valid if the recovery of the endotoxin challenge was between 50 and 150% of theory. The final purified CB155 typically had >95% purity by SDS-PAGE, >90% specific activity, and contained approximately 50 to 500 EU/ml of endotoxin.

Example 4

Large Scale Fermentation of MT-SP1 and Mutants

Large scale fermentation of MT-SP1 mutants based on the protocol described in Example 3 has been performed. A 2 liter culture of a selected *E. coli* colony transformed with mutant MT-SP1 was grown overnight in LB media (Difco). The overnight culture was seeded into 50 L fermentation and grown for about 5 hours with shaking at 37° C. until absorbance at OD600 reached log phase. Expression of the protease in inclusion bodies was induced with the addition of IPTG to a final concentration of 700 µM and fermentation was continued for an additional 4 hours in fed-batch mode. The culture was harvested by centrifugation to yield a wet weight cell pellet of about 750 grams to 1680 grams. The cell pellet was resuspended and sonicated in 50 mM Tris, pH 8.0, 0.5 M KCl, 10% glycerol, 1 mM beta-mercaptoethanol at 10 ml buffer per 1 gram cell pellet. The sonication conditions were pulse on: 4s, pulse off: 6s, 700W, 30 minutes. The sonicated lysate was centrifuged at 7000 rpm for 30 minutes at 4° C. Supernatant was discarded and the pellets were resuspended in Wash Buffer I (50 mM Tris pH 8.0, 0.5 M KCl, 10% glycerol, 1 mM beta-mercaptoethanol, 0.01% Tween 20) at 10 ml buffer per 1 g of inclusion bodies using a spatula and vortexing. The inclusion bodies were centrifuged and washed two times. The inclusion body yield was about 176 to 506 grams.

Example 5

Production of MT-SP1 in *Pichia pastoris*

The production of multi-milligram amounts of the protease domain of MT-SP1 was carried out by fermentation in a BioFlo 3000 fermentor (New Brunswick Scientific, NJ) equipped with a 3.3 L capacity bioreactor using a SMD1168/pPIC9K:MTSP1 Sac SCI clone (Friedrich et al. (2002) *J. Biol. Chem.*, 277:2160-2168). ZA001 complex media (10 g/L yeast extract, 20 g/L peptone, 40 g/L glycerol, 5 g/L ammonium sulfate, 0.2 g/L calcium sulfate dehydrate, 2 g/L Magnesium sulfate hepahydrate, 2 g/L potassium sulfate, 25 g/L sodium hexametaphosphate, 4.35 ml/L PTM1) was inoculated with 100 ml of an overnight culture of the *P. pastoris* transformant. The culture was supplemented with 50% glycerol by fed-batch phase and induced for 18-24 hours with methanol controlled at 0.025%.

To purify recombinant MT-SP1 secreted into the culture media, cells and cell debris were removed by centrifugation at 5000 g for 30 minutes. The resulting supernatant was decanted, adjusted to pH 8.0 with 10 N NaOH, and filtered through a SartoBran 300 0.45+0.2 µM capsule (Sartorius). The supernatant was concentrated to 1 L by ultrafiltration using a 10 kDa ultrafiltration cartridge (NC SRT UF system with AG/Technologies UFP-10-C-5A filter), and the buffer was exchanged by cross-flow filtration into buffer A (50 mM Tris-HCL, 50 mM NaCl, 0.05% tween-80, pH 8.0). The filtration unit was rinsed once with 1 L buffer A, which was combined with the concentrate.

The concentrated MT-SP1-containing solution was applied onto a 150 ml benzamidine column, that had been equilibrated with buffer A, at a flow rate of 8 ml/min. The column was washed with 3 column volumes of buffer B (50 mM Tris-HCL, 1.0 M NaCl, 0.05% tween-80, pH 8.0) and eluted with 3 column volumes of buffer C (50 mM Tris-HCL, 1.0M L-arginine, 0.05% tween-80, pH 8.0). Fractions containing MT-SP1 activity were pooled and concentrated to 10 ml using a JumboSep concentrator (Pall Gelman) and a 10 kDa cutoff membrane. Once concentrated to 10 ml, the buffer was exchanged into buffer D (50 mM $Na_2HPO_4$, 125 mM NaCl, pH 5.5), and the volume was adjusted to 5-10 ml. The retentate was removed and the concentrator washed with buffer D, which was added to the concentrate. The total sample volume was adjusted to 15 ml.

The partially purified MT-SP1 from the benzamidine column was passed through a 5 ml Q-sepharose Fast Flow HiTrap Column (Amersham-Pharmacia Biotech) pre-equilibrated with 15 ml of buffer D. The flow through was collected, and the protein concentration was determined by measurement of OD280 (using an extinction coefficient of 2.012 mg/OD280). Purified MT-SP1 was then deglycosylated by the addition of 0.1 µl of Endoglycosidase H (ProZyme, 5 U/ml) per mg of protein and incubation overnight at 4° C. with gentle swirling followed by a subsequent anion exchange purification step (not required for CB155 MT-SP1 mutant).

The conductivity of the deglycosylated pool was adjusted to 2.0-3.0 mS/cm with Nanopure $H_2O$ and the pH was adjusted to 6.5 (about 200 to 300 ml final volume). MT-SP1 was then further purified by anion exchange chromatography by loading directly onto a Pharmacia Akta Explorer system using a 7 ml Source 15Q anion exchange column (Amersham-Pharmacia Biotech). The protein was eluted in a buffer containing 50 mM HEPES, pH 6.5 with a 0-0.33M NaCl gradient over 10 column volumes at a flow rate of 6 ml/min. Fractions containing protein were pooled, and benzamidine was added to a final concentration determined by measurement of OD280 and use of a theoretical extinction coefficient of 2.012 mg/OD280.

Example 6

Assessment of Plasma Activity

The activity in plasma of wildtype or modified proteases was determined by cleavage of the peptide substrate Ac-RQAR-AMC, which includes the MT-SP1 auto-activation site. One microliter of a 10 µM protease stock was diluted into 9 µl PBST or 9 µl pooled human citrated plasma (Innovative Research; Sarasota, Fla.) (1 µM final). The reaction was incubated for 5 minutes at 37° C. At the end of the incubation, 1 µl of the incubated protease mixture was diluted into 250 µl assay buffer (50 mM Tris, pH 8.0, 50 mM NaCl, 0.01% Tween-20). 1 µl of the Ac-RQAR-AMC substrate (6.25 mM in DMSO) was added to each well of a Nunc black microtiter plate and 50 µl of the diluted, incubated protease mixture was added to the well. Cleavage of the substrate was monitored using a Spectromax fluorescence plate reader by taking kinetic measurements with the excitation wavelength at 380 nm and the emission wavelength at 450 nm. Fractional activity of the protease was calculated as a ratio of the activity of the protease in plasma divided by the activity in PBST.

The plasma activity of wildtype MT-SP1 or a panel of MT-SP1 mutants was determined in parallel with assessment of the proteases in hemolytic assays (see Example 7 below). The results are set forth in Table 23 below.

Example 7

Hemolytic Assays for Screening and Titrating Protease Activity by Detection of Complement-Induced Hemolysis of Red Blood Cells The functional activity of the complement system can be assessed using traditional hemolytic assays, which screen for function of the total complement pathway by determining the ability of the sample to lyse erythrocytes. Serial dilutions of the sample to be analyzed are incubated with antibody-sensitized sheep erythrocytes at a defined temperature. The number of red cells lysed is determined by spectrophotometric absorbance of released hemoglobin, which has a linear relationship to complement protein levels in the 50% lysis range. The results are usually expressed as reciprocal dilutions of the sample required to produce 50% lysis. Thus, when evaluating the activity of the components of the classical pathway, a $CH_{50}$ value can be determined. Tests evaluating the functional activity of the alternative pathway to determine the $AH_{50}$ (the titer at which 50% hemolysis occurs) use guinea pig, rabbit or chicken erythrocytes as target cells. Activation of the classical pathway is blocked by the addition of EGTA and Mg to the alternative pathway hemolytic assay.

Hemolytic assays can be modified to determine the effect of a given protease on complement activation. Protease is incubated with the plasma prior to co-incubation with the erythrocytes. Cleavage of complement products by the proteases will result in decreased complement activity. By incubating the plasma with serial dilutions of the proteases, an $IC_{50}$ can be determined, which is the concentration of protease at which 50% inhibition of complement activity is achieved.

A. Classical Hemolytic Assays

1. Classical Hemolytic Assay: Preincubation with 20% Plasma a. To assess complement activation following treatment with proteases, human plasma with sodium citrate as an anticoagulant (Innovative Research, Inc.) was diluted into PBST to a final concentration of 20% (10 µl plasma in 40 µl PBST) before addition of wildtype MT-SP1, CB155, or CB42 diluted to a final concentration of 0-1 µM. The reaction was incubated at 37° C. for 1 hour. The plasma solution was further diluted to a final concentration of 0.5% in a solution of sheep's red blood cells activated with IgG (6.25 µl plasma solution in 250 µl sheep's red blood cell solution, Diamedix (Miami, Fla.)). The solution was incubated with shaking at room temperature for 45 minutes. The cells were spun down at 2000 rpm for 2 minutes and 100 μl of the supernatant was removed and placed in a clear 96-well microtiter plate. Release of hemoglobin from the lysed red blood cells was monitored by reading the optical density (OD) at 415 nm. The $IC_{50}$ (nM) of hemolysis by wildtype MT-SP1, CB155, and CB42 was 131 nM, 94 nM, and 67 nM, respectively.

A panel of MT-SP1 modified proteases were tested for inhibition of hemolysis. Diluted human plasma containing sodium citrate as an anticoagulant was incubated with 200 nM of wildtype MT-SP1, CB12, CB13, CB31, CB32, CB40, CB41, CB42, CB43, CB44, CB45, CB64, CB66, CB67, and CB155. The reaction was incubated at 37° C. for 1 hour. The plasma solution was further diluted to a final concentration of 0.5% in a solution of sheep's red blood cells activated with IgG and hemolysis was assayed as described above. The CH50 value was determined. The fraction of hemolysis was determined by comparing the CH50 value of the wildtype or modified proteases compared to a sample containing no added protease (positive control) where the fraction of hemolysis of the positive control was set at 1.00. Table 22 depicts the raw fraction of hemolysis values. The data shows that all proteases tested inhibited hemolysis by at least 50% compared to the positive control with hemolysis completely inhibited in the presence of CB42.

TABLE 22

Inhibition of Hemolysis by a Panel of MT-SP1 Variants

| Protease | Fraction of Hemolysis |
| --- | --- |
| Wildtype | 0.14 |
| CB12 | 0.22 |
| CB13 | 0.50 |
| CB31 | 0.51 |
| CB32 | 0.38 |
| CB40 | 0.48 |
| CB41 | 0.32 |
| CB42 | 0.00 |
| CB43 | 0.23 |
| CB44 | 0.48 |
| CB45 | 0.27 |
| CB64 | 0.34 |
| CB66 | 0.44 |
| CB67 | 0.33 |
| CB155 | 0.09 |
| Negative control | 0.00 |
| Positive control | 1.00 | b. In another experiment, to assess classical complement activation following treatment with proteases, proteases were initially diluted in PBST to a concentration of 5.0 μM for screening protocols, while serial dilutions of the proteases from 50 μM to 0.390 μM were used for protocols to determine the $IC_{50}$. MT-SP1 or modified proteases were preincubated with a final concentration of 20% plasma in an 0.2 ml tube by combining 2 μl of the diluted protease solution, 10 μl of human plasma (with sodium citrate as an anticoagulant; Innovative Research, Inc.) and 38 μl of PBST. This resulted in a further dilution of the protease to give a final concentration of 200 nM protease for the screening protocol, and 2.0 μM to 0.0156 μM protease for the $IC_{50}$ protocol. A no-protease control (10 μl plasma and 40 μl PBST) and a background control (50 μl PBST only) also were included in the assays. The reaction was incubated at 37° C. for 1 hour. Sensitized sheep erythrocytes (Diamedex, Miami, Fla.) were added to polypropylene 96-well plates at a volume of 120 μl per well, and 3 μl of the plasma/protease solution was mixed into each well giving a final plasma concentration of 0.5%. The solution was incubated with shaking at room temperature for 45 minutes. The cells were spun down at 2000 rpm for 5 minutes in a Sorvall table top centrifuge to pellet the unbroken cells, and 100 μl of the supernatant was removed and placed in a clear 96-well microtiter plate. Release of hemoglobin from the lysed red blood cells was monitored by reading the optical density (OD) at 415 nm. The fraction hemolysis was calculated by subtracting the background control from all of the wells, then dividing the experimental samples by the no-protease control (positive control), where the fraction of hemolysis of the positive control was set at 1.00. The $IC_{50}$ (nM) of hemolysis by the proteases were measured by plotting the fraction hemolysis versus protease concentration on a 4 parameter logistic curve fit (SoftMax Pro software, Molecular Devices, CA).

A panel of MT-SP1 modified proteases was tested for inhibition of hemolysis through cleavage of one or more components of the classical complement pathway. Diluted human plasma containing sodium citrate as an anticoagulant was incubated with either 200 nM, or serial dilutions from 2.0 μM to 0.0156 μM, of wildtype MT-SP1 (CB200), CB12, CB16, CB17, CB20, CB21, CB42, CB43, CB44, CB45, CB66, CB80, CB82, CB155, CB212, CB213, CB214, CB216, CB218, CB219, CB232, CB235, CB238, CB244, CB245, CB251, CB252, CB255, CB257, CB268, CB274, CB331, CB332, CB349, CB350, CB351, CB353, CB357, CB367, CB373, CB377, CB381, CB383, CB385, CB387, CB388, CB403, CB409, CB412, CB413, CB421, CB422, CB423, CB450, CB451, CB458, CB464, CB486, CB487, CB488, CB489 and CB490. The reaction was incubated at 37° C. for 1 hour. The protease/plasma solution was further diluted in sensitized sheep erythrocytes and hemolysis was assayed as described above. The fraction hemolysis and $ID_{50}$ was determined. Table 23 depicts the fraction hemolysis at 200 nM (Classical 200 nM hemolysis) and the $IC_{50}$ for each protease (20% plasma pre-incubation).

2. Classical Hemolytic Assay: Preincubation with 90% Plasma

The modified classical hemolytic assay can be adapted further to measure the inhibitory activity of proteases under more physiological conditions by adjusting the plasma and protease concentrations. Proteases were initially diluted in PBST to a concentration of 50 μM for screening protocols, while serial dilutions of the proteases from 200 μM to 1.56 μM were used for protocols to determine the $IC_{50}$. MT-SP1 or modified proteases were preincubated with a final concentration of 90% plasma in an 0.2 ml tube by combining 2 μl of the diluted protease solution, 18 μl of human plasma (with sodium citrate as an anticoagulant; Innovative Research, Inc.). This resulted in a further dilution of the protease to give a final concentration of 5.0 μM protease for the screening protocol, and 20 μM to 0.156 μM protease for the $IC_{50}$ protocol. A no-protease control (18 μl plasma and 2 μl PBST) and a background control (20 μl PBST only) also were included in the assays. The reaction was incubated at 37° C. for 1 hour. The reaction mixtures were further diluted to 20% plasma with the addition of 70 μl PBST. Sensitized sheep erythrocytes (Diamedex, Miami, Fla.) were concentrated to 10× by pelleting a 3.0 ml aliquot, removing 2.7 ml of buffer and resuspending the cell pellet in the remaining 0.3 ml buffer. The concentrated sensitized erythrocytes were added to polypropylene 96-well plates at a volume of 12 μl per well. Preincubated protease/plasma mixtures at 6 μl or 60 μl were added to the erythrocytes to give a final concentration of 1% plasma or 10% plasma, respectively, in a final volume of 120 µl (PBST added to final volume). The solution was incubated with shaking at room temperature for 45 minutes. The cells were spun down at 2000 rpm for 5 minutes to pellet the unbroken cells, and 100 µl of the supernatant was removed and placed in a clear 96-well microtiter plate. Release of hemoglobin from the lysed red blood cells was monitored by reading the optical density (OD) at 415 nm. The fraction hemolysis was calculated by subtracting the background control from all of the wells, then dividing the experimental samples by the no-protease control (positive control), where the fraction of hemolysis of the positive control was set at 1.00. The $IC_{50}$ (nM) of hemolysis by the proteases were measured by plotting the fraction hemolysis vs protease concentration on a 4 parameter logistic curve fit (SoftMax Pro software, Molecular Devices, CA).

Wildtype MT-SP1 (CB200), and MT-SP1 mutants CB252 and CB377 were tested for inhibition of hemolysis following preincubation with 90% plasma. Preincubated protease/plasma mixtures (at a final concentration of 20 nM to 2000 nM protease) were incubated with sensitized erythrocytes at a final plasma concentration of 10% and hemolysis was assessed as described above. The $IC_{50}$ of hemolysis was determined as described above. The $IC_{50}$ of CB200, CB252 and CB377 was 967 nM, 379 nM, and 205 nM, respectively.

Modified MT-SP1 CB450 also was assessed for in vitro classical pathway-induced hemolysis following preincubation with 90% plasma. Preincubated protease/plasma mixtures (at a final concentration of 20 nM to 2000 nM protease) were incubated with sensitized erythrocytes at a final plasma concentration of 1% and 10% and hemolysis was assessed as described above. The results show that CB450 dose-dependently decreased hemolysis induced by 1% or 10% plasma, with slightly greater inhibition of hemolysis observed upon induction by 1% plasma. For example, there was no detectable hemolysis observed upon induction in 1% plasma in the presence of 100 nM or greater CB450, whereas induction in 10% plasma required a higher yield of protease to achieve complete inhibition of hemolysis (i.e. about 750 nM or greater CB450 protease).

B. Alternative Hemolytic Assay

1. Alternative Hemolytic Assay: Preincubation with 20% Plasma

To assess alternative complement activation following treatment with proteases, proteases were initially diluted in GVB/Mg/EGTA buffer containing gelatin veronal buffer (GVB; Comptech) with 10 mM $MgCl_2$ and 8 mM EGTA. The proteases were diluted to a concentration of 7.5 µM for screening protocols, while serial dilutions of the proteases from 30 µM to 0.2344 µM were used for protocols to determine the $IC_{50}$. MT-SP1 or modified proteases were preincubated with a final concentration of 20% plasma in a well of a 96-well polypropylene plate by combining 5 µl of the diluted protease solution, 15 µl of human plasma (with sodium citrate as an anticoagulant; Innovative Research, Inc.) and 55 µl of GVB/Mg/EGTA buffer. This resulted in a further dilution of the protease to give a final concentration of 500 nM protease for the screening protocol, and 2.0 µM to 0.0156 µM protease for the $IC_{50}$ protocol. A no-protease control (15 µl plasma and 60 µl GVB/Mg/EGTA) and a background control (75 µl GVB/Mg/EGTA only) also were included in the assays. The reaction was incubated at room temperature for 1 hour. Following the incubation, 5 µl GVB/Mg/EGTA was added to the incubated mixture, followed by 20 µl of washed chicken alsevyrs (50% mix of whole blood from chickens and alsevers solution, which contains anti-coagulants; Colorado Serum Company, CO) giving a final plasma concentration of 15%. Prior to the addition, the chicken alsevyr were sensitized as described in Example 19 below and the cells were centrifuged and washed 3 times in cold PBS and resuspended in 10 ml GVB/Mg/EGTA, and stored on ice until use. The plates were shaken at 37° C. for 1 hour. The cells were spun down at 2000 rpm for 5 minutes to pellet the unbroken cells, and 100 µl of the supernatant was removed and placed in a clear 96-well microtiter plate. Release of hemoglobin from the lysed red blood cells was monitored by reading the optical density (OD) at 415 nm. The fraction hemolysis was calculated by subtracting the background control from all of the wells, then dividing the experimental samples by the no-protease control (positive control), where the fraction of hemolysis of the positive control was set at 1.00. The $IC_{50}$ (nM) of hemolysis by the proteases were measured by plotting the fraction hemolysis vs protease concentration on a 4 parameter logistic curve fit (SoftMax Pro software, Molecular Devices, CA).

A panel of MT-SP1 modified proteases were tested for inhibition of hemolysis through cleavage of one or more components of the alternative complement pathway. Human plasma containing sodium citrate as an anticoagulant was incubated with either 500 nM, or serial dilutions from 2.0 µM to 0.0156 µM, of wildtype MT-SP1 (CB200), CB12, CB16, CB17, CB20, CB21, CB42, CB43, CB44, CB45, CB66, CB80, CB82, CB155, CB212, CB213, CB214, CB216, CB218, CB219, CB232, CB235, CB238, CB244, CB245, CB251, CB252, CB255, CB257, CB268, CB274, CB331, CB332, CB349, CB350, CB351, CB353, CB0357, CB367, CB373, CB377, CB381, CB383, CB385, CB387, CB388, CB403, CB409, CB412, CB413, CB421, CB422, CB423, CB450, CB451, CB458, CB464, CB486, CB487, CB488, CB489 and CB490. The reaction was incubated at room temperature for 1 hour. The protease/plasma solution was further diluted in chicken erythrocytes and hemolysis was assayed as described above. The fraction hemolysis and $ID_{50}$ was determined. Table 23 depicts the fraction hemolysis at 500 nM (Alternative 500 nM hemolysis) and the $IC_{50}$ for each protease (20% plasma pre-incubation).

TABLE 23

Assessment of Hemolysis and Plasma Activity by a Panel of MT-SP1 mutants

| CB# | Mutations | Classical 200 nM Hemolysis | Alternative 500 nM Hemolysis | Classical $IC_{50}$ Hemolysis (nM) | Alternative $IC_{50}$ Hemolysis (nM) | Plasma Activity |
|---|---|---|---|---|---|---|
| CB200 | wt | 0.14 | 0.14 | 131 | 545 | 0.2 |
| CB12 | F97D | 0.109 | 0.229 | 127.15 | | 0.2 |
| CB16 | Y146F | 0.058 | 0.049 | 182.6 | 204.95 | 0.23 |
| CB17 | L172N | 0.198 | 0.044 | 211.7 | 180 | 0.19 |
| CB20 | Q175D | 0.106 | 0.071 | 125.4 | 138.4 | 0.13 |

TABLE 23-continued

Assessment of Hemolysis and Plasma Activity by a Panel of MT-SP1 mutants

| CB# | Mutations | Classical 200 nM Hemolysis | Alternative 500 nM Hemolysis | Classical IC$_{50}$ Hemolysis (nM) | Alternative IC$_{50}$ Hemolysis (nM) | Plasma Activity |
|---|---|---|---|---|---|---|
| CB21 | Q175E | 0.156 | 0.047 | 123.7 | 81.7 | 0.16 |
| CB42 | Y146E | 0.072 | 0.088 | 91.6 | 117.5 | 0.19 |
| CB43 | Y146A | 0.195 | 0.226 | 160.2 | | 0.07 |
| CB44 | Y146W | 0.229 | 0.114 | 157.33 | | 0.14 |
| CB45 | Y146R | 0.195 | 0.297 | 170.42 | | 0.07 |
| CB66 | K224A | 0.236 | 0.097 | 166.3 | 102.2 | 0.24 |
| CB80 | R60cD | 0.085 | 0.463 | 82 | 367 | 0.23 |
| CB82 | R60cW | 0.147 | 0.48 | 74.8 | 283 | 0.29 |
| CB155 | Y146D/K224F | 0.09 | 0.29 | 94 | 221 | 0.36 |
| CB212 | Y146N/K224F | 0.477 | 0.538 | 371.5 | | 0.47 |
| CB213 | Y146E/K224F | 0.188 | 0.21 | 168.5 | | 0.29 |
| CB214 | Y146A/K224F | 0.197 | 0.32 | 171.25 | | 0.42 |
| CB216 | Q192V/K224F | 0.892 | 0.866 | 1200 | | 0.47 |
| CB0218 | Q192F/K224F | 0.975 | 0.947 | 1000 | | 0.09 |
| CB219 | Y146D/Q192A/K224F | 0.929 | 0.887 | 1100 | | 0.63 |
| CB232 | Y146E/K224L | 0.024 | 0.082 | 74.8 | 94.2 | 0.23 |
| CB235 | Y146E/K224A | 0.035 | 0.126 | 96.7 | 89.8 | 0.26 |
| CB238 | Y146D/K224L | 0.023 | 0.105 | 91.4 | 149.3 | 0.53 |
| CB244 | Y146D/K224R | 0.046 | 0.562 | 66.08 | 617.5 | 0.18 |
| CB245 | Y146D/K224N | 0.05 | 0.51 | 127.84 | 421.5 | 0.32 |
| CB251 | Y146E/K224R | 0.052 | 0.47 | 57.57 | 625 | 0.19 |
| CB252 | Y146E/K224N | 0.025 | 0.405 | 38.98 | 451.5 | 0.27 |
| CB255 | Y146E/K224T | 0.115 | 0.84 | 179.46 | 580.1 | 0.55 |
| CB257 | Y146E/K224Y | 0.032 | 0.548 | 118.65 | 158 | 0.44 |
| CB268 | Q221aD | 0.049 | 0.359 | 55.3 | 512 | 0.2 |
| CB274 | G147E | 0.102 | 0.441 | 80.7 | 311.5 | 0.23 |
| CB331 | I41D/Y146D/K224L | 0.8 | 0.19 | 325.15 | 76.4 | 0.34 |
| CB332 | I41E/Y146D/K224L | 0.254 | 0.124 | 150.05 | 52.3 | 0.53 |
| CB349 | I41D/Y146D/K224F | 0.775 | 0.188 | 359.28 | 110.17 | 0.61 |
| CB350 | I41E/Y146D/K224F | 0.729 | 0.24 | 284.14 | 177.07 | 0.69 |
| CB351 | I41T/Y146D/K224F | 0.144 | 0.245 | 50.31 | 71.25 | 0.71 |
| CB353 | H143V/Y146D/K224F | 0.278 | 0.193 | 160.85 | 461.4 | 0.26 |
| CB357 | I41T/Y146D/K224L | 0.068 | 0.203 | 88.58 | 126.26 | 0.41 |
| CB367 | Y146D/Q175D/K224R | 0.1 | 0.219 | 86 | 146.92 | 0.31 |
| CB373 | Y146E/Q175D/K224R | 0.093 | 0.268 | 73.48 | 123.2 | 0.34 |
| CB377 | Y146E/Q175D/K224N | 0.052 | 0.284 | 58.7 | 102.87 | 0.61 |
| CB381 | Y146D/Q175H/K224L | 0.169 | 0.219 | 111.55 | 291.86 | 0.25 |
| CB383 | Y146D/Q175L/K224L | 0.153 | 0.137 | 88.03 | 266.25 | 0.14 |
| CB385 | Y146D/Q175F/K224L | 0.184 | 0.207 | 123.13 | 472.11 | 0.18 |
| CB387 | Y146D/Q175W/K224L | 0.147 | 0.115 | 91.2 | 224.69 | 0.25 |
| CB388 | Y146D/Q175Y/K224L | 0.272 | 0.194 | 114.83 | 317.21 | 0.23 |
| CB403 | Y146D/D217F/K224L | 0.262 | 0.406 | 152.37 | 221.09 | 0.054 |
| CB409 | I41A/Y146D/K224F | 0.22 | 0.174 | 281.2 | | 0.498 |
| CB412 | I41L/Y146D/K224F | 0.165 | 0.247 | 262.5 | | 0.547 |
| CB413 | I41F/Y146D/K224F | 0.222 | 0.215 | 251.11 | | 0.446 |
| CB421 | I41T/Y146D/Q175D/K224F | 0.714 | 0.271 | 478.9 | | 0.585 |
| CB422 | I41T/Y146E/Q175D/K224N | 0.05 | 0.15 | 50.35 | | 0.511 |
| CB423 | I41T/Y146E/K224L | 0.061 | 0.176 | 180.19 | | 0.221 |
| CB450 | I41T/Y146D/G151L/K224F | 0.255 | 0.223 | 269.14 | | 0.287 |
| CB451 | Y146D/Q221aL/K224S | 0.147 | 0.416 | 130.46 | 173.07 | 0.12 |
| CB458 | Y146E/Q221aE/K224R | 0.136 | 0.58 | 93.25 | 332.95 | 0.21 |
| CB464 | Y146E/Q221aE/K224F | 0.02 | 0.124 | 52.3 | 91.15 | 0.54 |
| CB486 | I41T/Y146E/Q175D/K224R | 0.014 | 0.128 | 43.36 | | |
| CB487 | I41T/Y146E/G151L/Q175D/K224N | 0.026 | 0.173 | 52.87 | | 0 |
| CB488 | I41T/Y146E/G151L/Q175D/K224F | 0.086 | 0.195 | 72.61 | | |
| CB489 | I41T/Y146E/G151L/Q175D/K224L | 0.038 | 0.143 | 50.56 | | |
| CB490 | I41T/Y146E/G151L/Q175D/K224R | 0.031 | 0.125 | 52.63 | | |

2. Alternative Hemolytic Assay: Preincubation with 90% Plasma

The modified alternative hemolytic assay can be adapted further to measure the inhibitory activity of proteases, such as for example those with low activity, by adjusting the plasma and protease concentrations. Proteases were initially diluted in GVB/Mg/EGTA to a concentration of 50 µM for screening protocols, while serial dilutions of the proteases from 200 µM to 1.56 µM were used for protocols to determine the IC$_{50}$. MT-SP1 or modified proteases were preincubated with a final concentration of 90% plasma in a well of a 96-well polypropylene plate by combining 2 µl of the diluted protease solution with 18 µl of human plasma (with sodium citrate as an anticoagulant; Innovative Research, Inc.). This resulted in a further dilution of the protease to give a final concentration of 5.004 protease for the screening protocol, and 20 µM to 0.156 µM protease for the IC$_{50}$ protocol. A no-protease control (18 µl plasma and 2 µl GVB/Mg/EGTA) and a background control (20 µl GVB/Mg/EGTA only) also were included in the assays. The reaction was incubated at room temperature for 1 hour. After the incubation, 80 µl of GVB/Mg/EGTA was added to the incubated plasma/protease mix, followed by the addition of 20 µl of washed chicken cells (described above), giving a final plasma concentration of 15%. The plates were shaken at 37° C. for 1 hour. The cells were spun down at 2000 rpm for 5 minutes to pellet the unbroken cells, and 100 µl of the supernatant was removed and placed in a clear 96-well microtiter plate. Release of hemoglobin from the lysed red blood cells was monitored by reading the optical density (OD) at 415 nm. The fraction hemolysis was calculated by subtracting the background control from all of the wells, then dividing the experimental samples by the no-protease control where the fraction of hemolysis of the positive control was set at 1.00. The $IC_{50}$ (nM) of hemolysis by the proteases were measured by plotting the fraction hemolysis vs protease concentration on a 4 parameter logistic curve fit (SoftMax Pro software, Molecular Devices, CA).

Modified MT-SP1 CB450 was assessed for in vitro alternative pathway-induced hemolysis following preincubation with 90% plasma. Preincubated protease/plasma mixtures (at a final concentration of 20 nM to 2000 nM protease) were incubated with chicken cells at a final plasma concentration of 15% and hemolysis was assessed as described above. The results show that CB450 dose-dependently decreased hemolysis induced by 15% plasma, with no detectable hemolysis of the red blood cells observed at about 500 nM or greater CB450 protease.

Example 8

Detection of Complement-Induced Hemolysis of Red Blood Cells Using Complement-Depleted Sera a. To assess complement activation by purified complement factors treated in the presence or absence of wildtype MT-SP1, CB155, or CB42 protease, purified complement factors C2, C3, C4, and C5 and C2-, C3-, C4- and C5-complement depleted media were purchased from Quidel. Purified complement proteins (C2, C3, C4, or C5) were incubated with 100 nM wildtype MT-SP1, CB155 or CB42 protease at 37° C. for 3 hours. The concentration of the purified protein used in the reaction was 5 µM. One microliter of the reaction along with 1 µl of the appropriate complement depleted sera was added to 100 µl of sensitized sheep red blood cells and assayed for hemolytic activity as described in Example 7 above. The CH50 values of hemolysis were determined. The fraction of hemolysis of the samples was determined by comparing the CH50 value of the sample to the C2-sera containing sample containing no added protease which was set at 1.00 Table 24 depicts the raw fraction of hemolysis values. Wildtype MT-SP1, CB155, and CB42 proteases inactivate C2 and C3, but not C4 and C5 as determined by an inhibition of hemolysis.

TABLE 24

Hemolysis by Protease-incubated Complement Proteins Added Back to Complement-depleted Sera

| Protease | Fraction of Hemolysis |
|---|---|
| C2 | 1 |
| C2 + WT | 0 |
| C2 + CB155 | −0.00104 |
| C2 + CB42 | 0.071429 |
| C3 | 1.032325 |
| C3 + WT | 0.008342 |
| C3 + CB155 | 0.07195 |
| C3 + CB42 | 0.122449 |
| C4 | 0.957766 |
| C4 + WT | 0.970027 |

TABLE 24-continued

Hemolysis by Protease-incubated Complement Proteins Added Back to Complement-depleted Sera

| Protease | Fraction of Hemolysis |
|---|---|
| C4 + CB155 | 0.944142 |
| C4 + CB42 | 1.040816 |
| C5 | 0.983651 |
| C5 + WT | 0.888283 |
| C5 + CB155 | 0.942779 |
| CB + CB42 | 1.020408 | b. In another experiment, a panel of complement proteins was treated in the presence or absence of MT-SP1 (CB200), CB252, and CB377 to assess consequences on inactivation of purified complement proteins by the proteases. Purified complement proteins (all from Quidel; San Diego, Calif.) were incubated at their physiological serum concentrations (C1q: 180 µg/ml; C2: 25 µg/ml; C3: 1000 µg/ml; C4: 500 µg/ml; C5: 75 µg/ml; C6: 70 µg/ml; C8: 80 µg/ml; C9: 60 µg/ml) in PBST with 25 nM CB200, CB252, or CB377 protease. One µl of the reaction was added to 100 µl of sensitized sheep red blood cells in the presence of 1 µl of sera that was depleted for the corresponding complement factor (all depleted sera purchased from Quidel). As controls, a no protease control, depleted sera only, and normal sera only were included in the reactions. The samples were incubated in wells of a 96-well plate for 1 hour at room temperature with shaking. The cells were spun down by centrifugation to pellet the unbroken cells, and 85 µl of the supernatant was removed and transferred to a clear 96-well microtiter plate. Release of hemoglobin from the lysed red blood cells was monitored by reading the optical density (OD) at 415 nm. The results showed that the control depleted sera in the absence of the added corresponding purified complement protein showed little to no hemolysis as assessed by the OD415 reading, whereas the control normal sera exhibited hemolysis as assessed by an OD415 of about 0.4. For each of the reactions where the corresponding purified complement protein was added back to the depleted sera (no protease control), the OD415 reading was comparable to that observed with the normal sera. Preincubation of the complement proteins C1q, C3, C4, C5, C6, C7, C8, or C9 with CB200, CB252, or CB377 showed no decreased hemolysis as compared to normal sera or the no protease control. In contrast, preincubation of C2 with CB200, CB252, or CB377 resulted in an inhibition of hemolysis as assessed by a reduced OD415 absorbance to levels comparable to the depleted sera control.

Example 9

Visualization of the Proteolytic Cleavage of Complement Component C2 in Human Plasma by Western Blotting a. To visualize the proteolytic cleavage products, human plasma was diluted to 5% in 40 µl PBST and purified CB155, CB200, or CB42 was added to a final concentration between 0 and 500 nM. The samples were incubated for 1 hour at 37° C. Twenty microliters of the reaction, or purified complement C2 as a control (CompTech), was separated by SDS-PAGE on a 4-12% Tris-Glycine gel at 200 V for 35 minutes using a Novex Mini-Cell Surelock apparatus (Invitrogen), then transferred to PVDF membrane (Invitrogen) using a Bio-rad Transblot SD semi-dry transfer cell. The membrane was blocked 1 hour with 5% dry milk in TBST (Tris-buffered saline with 1% Tween 20) followed by washing and incubation with 1:3000 dilution of goat anti-human C2 antisera (Quidel) in 5% dry milk/TBST overnight at 4° C. The membrane was washed again three times in TBST for 10 minutes each wash, and incubated with 1:10,000 HRP conjugated rabbit anti-goat antibody (Invitrogen, Carlsbad, Calif.) in 5% dry milk/TBST for one hour at room temperature. The filter was washed three times in TBST for 10 minutes each wash, and the C2 in the plasma, and its cleavage products, were developed with ECL Plus Western Blotting Detection System (Amersham Biosciences) according to the manufacturer's instructions. Densitometry was performed on a Fluor Chem imaging system (Alpha Innotech Corp.) using AlphaEase FC Fluorchem 8800 software, version 3.1.2 (Alpha Innotech Corp.). Densitometry was used to determine the ratio of uncleaved product to cleaved product. The $IC_{50}$ of the proteases for cleavage of C2 was determined to be as follows: CB200: 15.7 nM; CB155: 18.4 nM; and CB42:11.9 nM.

b. In another experiment, the cleavage of C2 and C3 by wildtype MT-SP1 (CB200) and mutant MT-SP1 CB252 and CB377 was compared. Nine microliters of human citrated plasma (Innovative Research) was incubated with 1 μl of protease to give a final concentration of protease ranging from 0 to 2000 nM. Incubations were performed for 1 hour at 37° C. One microliter of the preincubated protease/plasma reaction was combined with 10 μl (for assessment of C2) or 1000 μl (for assessment of C3) NuPAGE LDS sample buffer and sample reducing reagent (Invitrogen, Carlsbad, Calif.) and boiled for 5 minutes. In parallel, 10 μl of the boiled samples were loaded onto 4-12% NuPAGE Bis-Tris gradient gels (Invitrogen) and run at 200 V for 35 minutes using the Novex Mini-Cell Surelock apparatus (Invitrogen) for protein separation, followed by transfer to a PVDF membrane filter (Invitrogen) using a Bio-Rad Transblot SD semi-dry transfer cell. The membranes were blocked with 5% dry milk (Bio-Rad, Hercules, Calif.) in TBST (Tris-buffered saline with 1% Tween 20) for 1 hour. The membranes were then incubated with goat anti-human C2 (Quidel) or goat anti-human C3 at 1:2000 in 5% dry milk/TBST overnight at 4 C. The membranes were washed three times in TBST for 10 minutes, and then incubated with HRP-conjugated anti-goat secondary antibody (Zymed; San Francisco, Calif.) at 1:2000 in 5% dry mil/TBST for one hour at room temperature. The membranes were washed three times in TBST for 10 minutes, and developed with ECL Plus Western Blotting Detection System (Amersham Biosciences; Piscataway, N.J.). Densitometry was performed with a Fluor Chem imaging system (Alpha Innotech Corp; San Leandro, Calif.) using Alpha Ease FC Fluorchem 8800 software, version 3.1.2 (Alpha Innotech Corp). The results show that each of CB200, CB252, and CB377 cleaved C2 in human plasma in a dose-dependent manner whereas none of the tested proteases cleaved C3 in human plasma as compared to the no protease control even at the highest concentration of protease (2000 nM). Degradation of C2 was noticeable by Western blot at 500 nM of each of the tested proteases with little to no detectable C2 observed at 1000 nM and complete degradation of C2 evident at 2000 nM of tested proteases.

Example 10

Assessment of Alternative and Classical Hemolysis and Correlation with Proteolytic Cleavage of Complement Component C3 in Human Plasma A panel of proteases was screened at a final concentration of 200 nM (classical) or 500 nM (alternative) for their effects on classical hemolysis or alternative hemolysis, respectively, following preincubation with human plasma as set forth in Example 7, A.1 and B.1 as described above. The panel of proteases that were tested included wildtype (CB200), CB238, CB331, CB349, CB357, CB367, CB377, and CB387. CB200, CB357, CB367, and CB387 inhibiting both the classical and alternative hemolysis to varying degrees. CB238 and CB377 showed little alternative hemolysis inhibition, but did show substantial inhibition of classical hemolysis. CB331 and CB349 showed little classical hemolysis inhibition, but did exhibit inhibition of alternative hemolysis. The results showed that CB331, CB349, and CB387 were selective for cleaving the alternative pathway as compared to the classical pathway.

The hemolysis results were correlated to cleavage of C3 in plasma as assessed by the visualization of C3 in the presence or absence of protease. Samples from the alternative hemolysis assay also were examined by Western blot for C3 as described in Example 9 above. Consistent with the alternative hemolysis results, the results show that CB331, CB349, and CB387 cleave C3 as assessed by decreased C3 product as compared to the no protease treated plasma sample.

Example 11

Cleavage of Purified Complement Components and Identification of Cleavage Sites

To determine increased specificity of modified proteases for a target protein compared to a scaffold or wildtype protease, purified complement factors C2, iC3, and iC4 were purchased from Quidel Corporation (San Diego, Calif.). 5 μg of each protein was diluted to a final concentration of 5 μM in PBST. MT-SP1, CB155, or Factor I were added to a final concentration of 100 nM, and the reaction was incubated at 37° C. for 5 hours. N-linked glycosylation was removed by denaturing the protein and treating with PNGaseF according to the manufacturer's protocol (New England BioLabs, Ipswich, Mass.). The target proteins were separated by SDS-PAGE on a 4-12% Tris-Glycine gradient gel (Invitrogen, Carlsbad, Calif.) followed by transfer to a PVDF membrane. The resulting membrane was stained with Coomassie Brilliant Blue R-250 stain (TekNova, Hollister, Calif.), rinsed with 50% methanol until the protein band resolved, and air dried. Proteolytic fragments were sequenced according to the Edmans' protocol by the UC Davis Molecular Structure Facility to determine the cleavage sequences. Table 25 below depicts the protease cleavage sequences of human C2, C3, and C4. Where cleavage occurred, the respective cleavage sites on C2, C3 and C4, as identified from sequencing of the cleavage products, are shown for the natural protease Factor I, cathepsin K, MT-SP1, and modified MT-SP1 (CB155). The respective SEQ ID NOS are indicated in parentheses next to the sequence.

TABLE 25

Protease Cleavage Sequences

| | MT-SP1 | CB155 | Cathepsin K | Factor I |
|---|---|---|---|---|
| Human C2 | GATR (391) SLGR (392) VFAK (393) | GATR (391) SLGR (392) | | |
| HumanBeta C3 chain Alpha chain | GLAR (395) RLGR (396) AEGK (397) | REFK (394) QHAR (398) | LGLA (399) LSVV (400) | LPSR (388) SLLR (389) |
| HumanBeta C4 chain Alpha chain Gamma chain | HRGR (390) | | | HRGR (390) |

Example 12

Correlation of C2 Cleavage with Complement Inactivation: Assessment of the Formation of C3 Convertase and Hemolysis C3 convertase is formed by the interaction of C1 complex with C4 and C2. Activation of the C1r protease in the C1 complex cleaves C1s yielding an active C1s protease. C4 is a sensitive substrate for C1s, thereby resulting in cleavage of C4 into C4a and C4b. The generation of an active C4b provides a binding site for C2, a second substrate for C1s. Cleavage of C2 results in the formation of fragments C2a and C2b. Upon cleavage by C1s, the C4b and C2b fragments become associated, which together form the C3 convertase of the classical pathway. The SLGR cleavage site present in C2 is the natural activation site for C2 cleavage yielding C2a and C2b, whereas the VFAK cleavage sequence in C2 is present within the protease domain of C2 in the C2a portion of the molecule. To assess whether cleavage of cleavage sequences in C2 by wildtype or modified MT-SP1 affects activation of C2 and the formation of C3 convertase, cleavage was assessed and the functional consequences of cleavage were determined in an in vitro reconstituted cell surface hemolysis model.

A. C2 Cleavage

The presence of C2a and C2b cleavage products was assessed after cleavage of purified C2 by wildtype MT-SP1 (CB200), CB252, or CB377. To assess cleavage products upon incubation of purified C2 with proteases, 5 µg of purified C2 (Quidel) was incubated alone or with a final concentration of 100 nM CB200, CB252, or CB377 protease for 1 hour at 37° C. The entire reaction was separated by SDS-PAGE on a 4-12% Tris-Glycine gradient gel (Invitrogen, Carlsbad, Calif.) followed by transfer to a PVDF membrane. The resulting membrane was stained with Coomassie Brilliant Blue R-250 stain (TekNova, Hollister, Calif.), rinsed with 50% methanol until the protein band resolved, and air dried. The results show that in the presence of 100 nM CB200, CB252 or CB377, C2 was almost completely degraded to yield cleavage products of about 70 kD and 23 kD corresponding to C2a and C2b, respectively. In addition, in the presence of CB200a third cleavage product of about 35 kD was observed.

B. Cell Surface Hemolysis Model

The activity of MT-SP1 or modified protease on the C2 protein specifically was assayed by isolating cells in the intermediate stages of complement activation and exposing them to plasma or protein treated with the protease. Briefly, activated erythrocytes were stopped at the C1/C4b complex stage using the method of Nagaki et al (1974, A New Method for the Preparation of EAC14 cell with Human or Guinea-Pig Serum. *Journal of Immunological Methods* 5:307-317.) Purchased activated erythrocytes (Diamedix Corp) were washed three times by pelleting the cells at 2000 rpm followed by resuspension into GGVB-TTHA (50% GVB$^0$ (Diamedix Corp.)+5% glucose+5 mM Ca-TTHA (equal parts of 100 mM $CaCl_2$ with 100 mM TTHA (Sigma)), and after the final wash were resuspended at $5 \times 10^8$ cells/mL and stored on ice. The cells were mixed with 2.5 volumes of 10% normal human serum (NHS; made in GGVB-TTHA and incubated 15 minutes at 30° C. to ensure the chelation of $Mg^{2+}$) and incubated for 5 minutes at 30° C. The mixture was washed two times with GGVB-TTHA, washed two times with GGVB-Ca (50% GVB$^0$+5% glucose+0.3 mM $CaCl_2$), and washed two times with GGVB++ (50% GVB$^0$+ 5% glucose+1 mM $MgCl_2$+0.15 mM $CaCl_2$). After the final wash, the cell mixture was incubated 2 hours at 37° C. with mixing every 30 minutes to avoid excess settling of the cells. The incubated cell mixture was washed one time in GGVB++, and resuspended at $1.5 \times 10^8$ cells/mL. The suspension was stored up to 1 week at 4° C.

During complement activation, the C1/C4b complex is required to cleave C2 generating C3 convertase and the resultant activation of the remainder of the complement cascade resulting in the formation of the membrane attack complex (MAC) and cell lysis. To assess the consequences of C2 cleavage by protease, a 2× protease solution of any of CB200, CB252, CB377 was serially diluted by diluting a stock solution of the protease to 2 µM in GGVB++ and serially diluting this stock 1:2 across 11 wells of an opaque 96 well assay plate (Nunc) for final protease concentrations of 0.2 nM to 2000 nM. GGVB++ buffer alone was added to the 12th well as a background control. A 40% solution of C3 depleted sera (Sigma) was made by dilution with GGVB++. Five microliters of serially diluted 2× protease (from above) was mixed with 5 µL diluted C3-depleted sera and incubated for 1 hour at 37° C. The reaction was diluted to 50 µL with GGVB++ and 50 µL EAC14b cells (at $1.5 \times 10^8$ cells/mL) were added. The mixture was incubated for 6 minutes at 30° C. to pre-form the C2 complex. 150 µL C2 depleted sera, diluted 1:100 in GGVB-EDTA (50% GVB$^0$+5% glucose+10 mM EDTA), was added to each well. Samples were incubated 1 hour at 37° C. with gentle shaking. The plate was spun at 2000 rpm to pellet the cells and 100 µl of the supernatant was transferred into a clear 96 well assay plate. Release of hemoglobin from the lysed red blood cells was monitored by reading the optical density (OD) at 415 nm.

The results show that C3 depleted sera pre-incubated with increasing concentrations of proteases (CB200, CB252, or CB377) conferred reduced hemolysis of erythrocytes containing preformed C1/C4b when added to sera depleted for C2. The effects of each of the tested proteases were dose-dependent with little to no inhibition evident at concentrations ranging from 0.2 nM to 10 nM of protease, with successive inhibition occurring at increasing protease concentrations with little to no hemolysis observed at protease concentrations of 800 nM or more. These results suggest that preincubation of sera containing C2 in the presence of proteases does not mimic cleavage of C2 by C1/C4b required for complement activation and cell lysis.

Example 13

Determination of the Inhibitory Cleavage Site by Paired SDS-PAGE and Hemolytic Assays To correlate protease cleavage of complement components with inhibition of complement activation, purified complement factors were purchased from Quidel and CompTech. 5 μg of each protein was diluted to a final concentration of 5 μM in PBST. A scaffold or modified protease was diluted to a final concentration between 0 and 500 nM. Samples were incubated for 1 hour at 37° C. 0.5 to 1 μg of the treated complement component was removed and diluted to a total volume of 10 μl with PBST. This reaction was mixed with 250 μl IgG-activated sheep's red blood cells and 5 μl media depleted of the corresponding complement factor to be assayed. The solution was allowed to incubate at room temperature for 45 minutes. The cells were spun down at 5000 rpm for 2 minutes and 200 μl of the supernatant was transferred to a 96-well microtiter plate and absorbance at 415 nm was measured to determine release of hemoglobin from the lysed red blood cells.

The remaining 4 to 4.5 μg of the reaction sample was deglycosylated according to the manufacturer's protocol for PNGaseF (New England BioLabs). The samples were separated by SDS-PAGE on a 4-12% Tris-Glycine gradient gel followed by staining with Coomassie Brilliant blue stain. Using the densitometry feature on an Alpha Innotech Imager, the area of each band was determined and used to calculate the percentage of the full length complement component cleaved throughout the assay and the appearance of all major degradation products.

Example 14

Correlation of C2 Cleavage with Complement Inactivation as Assessed by Hemolysis in C2 Depleted Sera The functional consequence of C2 cleavage of complement-mediated hemolysis was assessed in a paired SDS-PAGE and hemolytic assay as described above in Example 13. To assess complement activation by purified complement factors, purified C2 and C2-depleted media were purchased from Quidel. 0.5 to 1 of purified C2 was incubated with 10 to 500 nM CB155 protease in a total of 10 μl PBST for 1 hour at 37° C. The entire reaction was added to 250 μl of IgG-activated sheep's red blood cells along with 5 μl of plasma depleted of the C2 complement factor being assayed. The solution was allowed to sit at room temperature for 45 minutes. The cells were spun down at 5000 rpm for 2 minutes and 200 μl of the supernatant was transferred to a 96-well microtiter plate and absorbance at 415 nm was measured to determine release of hemoglobin from the lysed red blood cells.

To visualize the proteolytic cleavage products, twenty microliters of the reaction, or purified complement C2 as a control (CompTech), was separated by SDS-PAGE on a 4-12% Tris-Glycine gel and total protein was visualized by staining the gel with Coomassie Blue according to the manufacturer's protocol. The cleavage of C2 was compared using gel densitometry. Cleavage of C2 occurred in a dose-dependent manner with almost complete cleavage of C2 occurring at 500 nM of protease. Further, the percent hemolysis decreased with increasing concentrations of the protease. The $IC_{50}$ of CB155 based on gel densitometry of C2 cleavage products was 2.2 nM. The $IC_{50}$ of CB155 for hemolysis in C2 depleted serum supplemented with protease-treated C2 was 17 nM. In vitro, complete degradation of purified C2 is required for the functional decrease in hemolysis.

Example 15

Detection of C5b-9 (Membrane Attack Complex) by ELISA and Effects of MT-SP1 or Mutants on Complement Activation A. C5b-9 ELISA ELISAs for C5b-9 were performed according to the manufacturer's protocol (Quidel). Briefly, microtiter plates coated with the capture antibody were rehydrated with SuperBlock (Pierce, Rockford, Ill.) for 30 minutes at room temperature. The plates were washed in PBST and 20 μl of the protease-treated, complement stimulated serum solution from above diluted with 80 μl SuperBlock was added to wells of a microtiter plate. The plates were incubated at room temperature for 1 hour and then washed in PBST. 100 μl of the detection antibody-HRP conjugate solution was added and the plates were incubated for 1 hour and then washed in PBST. Finally, 100 μl of the substrate solution was added and the plates were incubated about 15 minutes at room temperature to develop. To stop the developing reaction, 100 μl of stop solution was added to each well and absorbance at 450/650 nm was measured according to the manufacturer's protocol.

B. Effects of Wildtype MT-SP1 (CB200), CB155 or CB42 on Complement Activation

To detect complement activation, human plasma with sodium citrate as an anticoagulant (Innovative Research, Inc., Southfield, Mich.) was diluted into PBS with 0.05% Tween 20 (PBST) to a final concentration of 20% (10 μl serum in 40 μl PBST), to which wildtype MT-SP1, CB155, or CB42 was added to a final concentration of 0-5 μM. The solution was incubated at 37° C. for 15 minutes. Activation of the classical pathway and activation of the alternative pathway was initiated by the addition of lipopolysaccharide (IgG or LPS, respectively at 1 mg/ml final concentration, Sigma). The reaction was incubated at 37° C. for 30 minutes. The reaction was quenched by adding Pefabloc (Roche) to a final concentration of 1 mg/ml and EDTA to a final concentration of 50 mM. 20 μl of the final solution was used for the subsequent ELISA. The ELISA was performed as described in part A above.

The IC50 of C5b-9 generation for each of the proteases was determined. The $IC_{50}$ following activation of the classical pathway for wildtype MT-SP1, CB155, and CB42 was determined to be 103 nm, 47 nm, and 23 nm, respectively. The $IC_{50}$ following activation of the alternative pathway for wildtype MT-SP1, CB155, and CB42 was determined to be 195 nm, 84 nm, and 41 nm, respectively.

Example 16

Effects of Wildtype MT-SP1 (CB200), CB252 or CB377 on Complement Activation in a Total Complement System Screen To assess the affect of MT-SP1 or mutant MT-SP1 proteases on the classical, MBL, or alternative complement pathways, 9 μl of human citrated plasma (Innovative Research) was incubated with 1 μl of CB200, CB252, or CB377 protease to give a final concentration of 1 μM of protease for 1 hour at 37° C. Each of the reactions was assessed for complement activation using the Total Complement System Screen Classical, Lectin, Alternative Pathways, according to the protocol from the manufacturer (WiesLab; Sweden). In this assay, the wells of the microtiter strips provided by the manufacturer are coated with specific activators of the classical, alternative, or MBL (lectin) pathways. The reaction was diluted into the appropriate buffer provided by the manufacturer to give the concentration of plasma for each pathway and the reaction was incubated as defined by the manufacturer. For the classical pathway, the plasma sample was diluted in Diluent CP and left at room temperature for a maximum of 60 minutes before analysis. For the lectin pathway, the plasma sample was diluted in Diluent LP and incubated at room temperature for greater than 15 minutes but less than 60 minutes before analysis. For the alternative pathway, the plasma sample was incubated in Diluent AP and left at room temperature for a maximum of 60 minutes before analysis. To the microtiter plate, samples were added at 100 μl/well in duplicate. The plate was incubated for 60-70 minutes at 37° C. After the serum incubation, the wells of the microtiter plate were washed three times with 300 μl washing solution. After the final wash, excess wash buffer was removed by tapping the plate on an absorbent tissue. Complement activation was assessed in each sample by detection of C5b-9. 100 μl of the conjugate containing alkaline phosphatase-labelled antibodies to C5b-9 was added to each well and the plate incubated for 30 minutes at room temperature. To develop the reaction, 100 μl substrate solution was added to each well and the plate incubated at room temperature for 30 minutes. The reaction was stopped by adding 5 mM EDTA at 100 μl/well. The absorbance was read at 405 nm using a microplate reader. The fraction of sC5b-9 generated was determined by comparing the OD405 value of the sample to a no protease control sample.

The results show that the fraction C5b-9 generated upon complement activation induced by the classical and MBL pathways was almost completely inhibited in the presence of each of the tested proteases (CB200, CB252, or CB377). In contrast, little to no inhibition of C5b-9 generation was observed by any of the tested proteases when complement activation was induced by the alternative pathway. Since the classical and MBL pathways require C2, but the alternative pathway does not, these results suggest that inhibition of the classical and MBL pathways is due to cleavage of C2. This result is consistent with the observation that each of the tested proteases (CB200, CB252, and CB377) when preincubated with C2 inhibit hemolysis (see Example 8.b above).

Example 17

Screening for Preferential Cleavage of SLGR or GLAR Versus RQAR Substrates

Modified proteases that match the desired specificity profiles, as determined by substrate libraries, were assayed using individual peptide substrates corresponding a desired cleavage sequence to determine the magnitude change in specificity. One native target substrate was designed: Ac-RQAR-AMC, which includes the MT-SP1 auto-activation site; and two desired substrate cleavage sequences were designed: Ac-SLGR-AMC (C2 cleavage site) and Ac-GLAR-AMC (C3 cleavage site).

The substrates were diluted in a series of 12 concentrations between 1 mM and 2 μM in 50 μl total volume of MT-SP1 activity buffer in the wells of a Costar 96 well black half-area assay plate. The solution was warmed to 30° C. for five minutes, and 50 μl of a protease solution (wildtype MT-SP1, CB42, or CB155) was added to the wells of the assay. The fluorescence was measured in a fluorescence spectrophotometer (Molecular Devices Gemini XPS) at an excitation wavelength of 380 nm, an emission wavelength of 450 nm and using a cut-off filter set at 435 nm. The rate of increase in fluorescence was measured over 30 minutes with readings taken at 30 second intervals. The kinetic constants $k_{cat}$, $K_m$, and $k_{cat}/K_m$ (specificity constant) were calculated by graphing the inverse of the substrate concentration versus the inverse of the velocity of substrate cleavage, and fitting to the Lineweaver-Burk equation $(1/velocity=(K_m/V_{max})(1/[S])+1/V_{max}$; where $V_{max}=[E]*k_{cat})$. The proteases wildtype MT-SP1 (CB200), CB42, and CB155 cut the Ac-RQAR-AMC substrate at $1.9 \times 10^6$, $1.8 \times 10^6$, and $9.1 \times 10^4$ $M^{-1}s^{-1}$, respectively. The proteases wildtype MT-SP1 (CB200), CB42, and CB155 cut the Ac-SLGR-AMC substrate at $2.0 \times 10^4$, $5.9 \times 10^4$, $3.7 \times 10^3$ $M^{-1}s^{-1}$, respectively. The proteases wildtype MT-SP1 (CB200), CB42, and CB155 cut the Ac-GLAR-AMC substrate at $6.4 \times 104$, $6.3 \times 104$, and $3.5 \times 103$ $M^{-1}s^{-1}$, respectively.

Example 18

Screening for Cleavage of Individual Substrates Versus a Full-Length Protein

The specificity of a wildtype or modified protease to a substrate cleavage sequence versus a full length complement protein was determined by comparing the specificity constant ($k_{cat}/K_m$) to measure how well a substrate is cut by a particular protein. A peptide substrate cleavage sequence was designed containing a C2 cleavage sequence: Ac-SLGR-AMC. The specificity constant ($k_{cat}/K_m$) of cleavage was determined as described above in Example 17 by incubating the substrate cleavage sequence with a protease (wildtype MT-SP1 (CB200), CB42, or CB155) and the rate of increase in fluorescence was determined.

In gel kinetics was used to determine the specificity constant of the target complement protein C2. The kinetics of cleavage of the C2 target protein was assayed by following by SDS-PAGE the depletion of the target in the presence of a small amount of protease over a time course. For this assay, 5 mM C2 was incubated with 10 nM protease (wildtype MT-SP1 (CB200), CB42, or CB155) in MTSP activity buffer at 37° C. for 5 hours. Aliquots were removed at 0, 10, 20, 40, 60, 100, 200 and 300 minutes, and immediately diluted and boiled in reducing agent. The samples were treated with PNGase F (New England Biolabs), separated by SDS-PAGE, and stained with Coomassie Brilliant Blue. The density of the full length protein band was determined using the Alpha Innotech Gel Imager. The specificity constant, $k_{cat}/K_m$ was determined by nonlinear fitting of the curve produced by plotting the integrated density value versus time with the equation:

$$density=exp(-1*time*[enzyme]*kcat/Km).$$

The results show that the specificity constant of cleavage of a substrate peptide sequence versus a full length protein by the proteases followed a similar pattern. The CB200 wildtype MT-SP1 showed almost identical specificity constants for cleavage of the substrate peptide sequence versus the C2 full length protein, whereas CB42 and CB155 showed slight variation in their specificity constants. The specificity constant of cleavage of the Ac-SLGR-AMC substrate sequence by CB200, CB42, and CB155 was $2.0 \times 10^4$, $5.9 \times 10^4$, and $3.7 \times 10^3$ $M^{-1}s^{-1}$, respectively. The specificity constant of cleavage of the C2 protein by CB200, CB42, and CB155 was $1.95 \times 10^4$, $3.60 \times 10^4$, and $7.20 \times 10^4$ $M^{-1}s^{-1}$, respectively.

Example 19

Cynomolgus Hemolysis Protocol

The functional activity of the Cynomolgus monkey complement system following protease treatment also can be assessed using modified hemolytic assays.

A. Sensitization of Chicken Red Blood Cells

Chicken red blood cells were isolated from Chicken Alsevers (50% mix of whole blood from chickens and alsevers solution, which contains anti-coagulants; Colorado Serum Company, CO). The cells were resuspended by gently pipetting up and down until no cell pellet was visible and 50 µl of cells were diluted into 1 ml GVB++ buffer. The volume of cells was scaled as necessary for each experiment assuming that 10 µl per well of the final 1 ml suspension would be added to each well so that a dilution of 50 µl cells was sufficient for one plate. The cells were washed by pelleting the cells at 2500 rpm in a tabletop centrifuge at 4° C. for 1 minute, the supernatant discarded, and cells resuspended in 1 ml GVB++ by gently pipetting up and down. The washing steps were repeated twice more or until the supernatant was completely clear upon the last spinning. One µl of anti-chicken erythrocyte antibody (Fitzgerald industries) was added to sensitize the cells. After the antibody—cell suspension was mixed, the solution was incubated on ice for a minimum of 15 minutes, then centrifuged at 2000 rpm in a tabletop centrifuge at 4° C. for 2 minutes. The supernatant was discarded and the sensitized cells were resuspended in 1 mL GVB++ and washed a further 2 times by centrifugation at 2000 rpm for 1 minute until the supernatant was clear. After the final wash, the cell pellet was resuspended in a final volume of 1 ml GVB++ and the cells were diluted 10:50 in GVB++ (i.e. 1 ml of resuspended sensitized cells 5 mL GVB++ for a total volume of 6 ml). Sensitization of the chicken cells with antibody was performed fresh the day of the experiment. The sensitized cells were not kept overnight.

B. Hemolysis Assay from In Vivo Pharmacodynamic (PD) Experiments

Hemolysis reactions were set up at a final concentration of 1%, 2.5%, and 10% plasma for each plasma sample obtained from protease treated animals or vehicle control (no protease) treated animals in the presence of sensitized erythrocytes. Absorbance controls containing no added concentrated sensitized erythrocytes also were set up in parallel for each sample. All reactions were set up in opaque plates with point divots. For the 1% plasma samples, the hemolysis samples (in duplicate) were set up with 10 µl sensitized erythrocytes, 89 µl GVB++, and 1 µl plasma from protease or no-protease treated animals; and the corresponding absorbance controls were set up with 99 µl GVB++ and 1 µl of plasma from protease treated animals. For the 2.5% plasma samples, the hemolysis samples (in duplicate) were set up with 10 µl sensitized erythrocytes, 87 µl GVB++ and 2.5 µl plasma from protease or no protease treated animals; and the corresponding absorbance controls were set up with 97 µl GVB++ and 2.5 µl plasma from protease treated animals. For the 10% plasma samples, the hemolysis samples (in duplicate) were set up with 10 µl sensitized erythrocytes, 80 µl GVB++, and 10 µl plasma from protease or no protease treated animals; and the corresponding absorbance controls were set up with 90 µl GVB++ and 10 µl plasma from protease treated animals. The plates were incubated with shaking at 37° C. for 30 minutes. The cells were centrifuged at 2000 rpm for 5 minutes to pellet the unbroken cells, and 80 µl of the supernatant was removed and placed in a clear 96-well round-bottom microtiter plate. This was done carefully since the samples were sometimes gelatinous. The samples that were gelatinous were noted. The supernatant-transferred plates were centrifuged at 2500 rpm for 5 minutes to remove bubbles. Centrifugation was repeated until no bubbles persisted or, alternatively, remaining bubbles were popped with an 18G needle. Release of hemoglobin from the lysed red blood cells was monitored photometrically by reading absorbance at 415 nm on a Bio-Rad Microplate Reader Model 680. If the absorbance was greater than 1, the samples were diluted 1:3 in GVB++ and read again (i.e. 20 µl sample into 40 µl GVB++). The fraction hemolysis was calculated by subtracting the absorbance from the absorbance control samples from the corresponding hemolysis well, then dividing the experimental samples by the no-protease vehicle control sample. ED50 values were determined by graphing the OD415 nm value as a function of protease concentration.

C. In Vitro Titration Hemolysis Assay

For an in vitro titration of proteases using cynomolgus monkey plasma, proteases at 10% of the final reaction volume were incubated with purchased cynomolgus monkey plasma (i.e. in polypropylene 96-well plates, 2 µl of the protease solution was added to 18 µl cynomolgus monkey plasma) to give final protease concentrations of protease of ranging from 20 µM to 0.156 µM for the $IC_{50}$ titration protocol, and a plasma concentration of 90%. A no-protease (18 µl plasma and 2 µl GVB/Mg/EGTA) and background (20 µl GVB/Mg/EGTA only) controls also were included in the assays. The reaction was incubated at room temperature for 1 hour. After preincubation of the protease with 90% plasma, hemolysis was performed as described in part B above. No absorbance controls were included in the in vitro hemolysis titration.

Example 20

Mouse Hemolysis Protocol

A. Hemolysis Assay from In Vivo Pharmacodynamic (PD) Experiments

The functional activity of the mouse complement system following protease treatment also can be assessed using modified hemolytic assays. Erythrocytes used in the mouse hemolysis protocols also were chicken red blood cells which were sensitized as described in Example 19, part A above. Hemolysis reactions were set up at a final concentration of 40% plasma for each plasma sample obtained from protease treated animals or vehicle control (no protease) treated animals in the presence of sensitized erythrocytes. Absorbance controls containing no added concentrated sensitized erythrocytes also were set up in parallel for each sample at half the plasma concentration (20% plasma), such that the absorbance control values were subtracted twice from the hemolysis values during analysis as discussed below. The hemolysis samples were set up in duplicate (if enough plasma allowed) in opaque plates with divots by adding 60 µl of concentrated sensitized erythrocytes and 40 µl of plasma from protease or no protease treated animal to each well. The corresponding absorbance control was set up by adding 80 µl GVB++ and 20 µl mouse plasma from protease or no protease treated animals to each well. The plates were incubated with shaking at 37° C. for 1 hour. The cells were centrifuged at 2000 rpm for 5 minutes to pellet the unbroken cells, and 50 µl of the supernatant was removed and placed in a clear 96-well round-bottom microtiter plate. This was done carefully since the samples were sometimes gelatinous. The samples that were gelatinous were noted. The supernatant-transferred plates were centrifuged at 2500 rpm for 5 minutes to remove bubbles. Centrifugation was repeated until no bubbles persisted or, alternatively, remaining bubbles were popped with an 18G needle. Release of hemoglobin from the lysed red blood cells was monitored by reading at 415 nm. If the absorbance was greater than 1, the samples were diluted 1:3 in GVB++ and read again (i.e. 20 µl sample into 40 µl GVB++). The fraction hemolysis was calculated by subtracting the 2× absorbance control samples from the corresponding hemolysis well, then dividing the experimental samples by the no-protease vehicle control. ED50 values were determined by graphing the OD415 nm value as a function of protease concentration.

B. In Vitro Titration Hemolysis Assay

For an in vitro titration of proteases using mouse plasma, proteases at 10% of the final reaction volume were incubated with purchased mouse plasma or in-house control plasma (i.e. in polypropylene 96-well plates, 2 µl of the protease solution was added to 18 µl plasma) to give final protease concentrations of protease of ranging from 20 µM to 0.156 µM for the $IC_{50}$ titration protocol, and a plasma concentration of 90%. A no-protease (18 µl plasma and 2 µl GVB/Mg/EGTA) and background (20 µl GVB/Mg/EGTA only) controls also were included in the assays. The reaction was incubated at room temperature for 1 hour. After preincubation of the protease with 90% plasma, hemolysis was performed as described in part A above. No absorbance controls were included in the in vitro hemolysis titration.

Example 21

Classical C3b Deposition ELISA

To detect and quantitate C3b deposition, 96 well Maxisorp plates (Nunc) were coated with 100 µl/well of 0.5% ovalbumin for 2 hrs at 37° C. or overnight at 4° C. The plates were washed 3 times with 250 µl PBST using a Molecular Devices SkanWasher 300 Version B. The plates were coated with 100 µl/well of rabbit anti-chicken egg albumin antibody (MP Biomedicals) diluted 1:1000 in PBS. The plates were incubated for 1 hr at room temperature or overnight at 4° C. before being washed 3 times with PBST. The plates were blocked with 200 µl Blocking Buffer (30% BSA Solution; Serologicals), and the plates were shaken at room temperature for 1 hour. After washing 3 times with PBST, 100 µl of plasma sample, diluted to the desired percentage (i.e. 1%, 10%) in GVB++(Veronal (barbital)-buffered saline, pH 7.4, containing 142 mM NaCl, 4.9 mM sodium Veronal, 0.1% gelatin, 0.15 mM $CaCl_2$, and 1 mM $MgCl_2$; Comptech), was added to each well, and the plates were shaken at room temperature for 30 minutes. The wells were washed 3 times with PBST. Goat anti-human C3b antibody (Quidel) diluted 1:4000 in blocking buffer was added to the wells at a volume of 100 and the plates were shaken at room temperature for 1 hour. After washing with PBST, 100 µl HRP-rabbit anti-goat conjugated antibody (Zymed) diluted 1:8000 in blocking buffer was added to the wells and allowed to incubate for 1 hour with shaking at room temperature. The wells were washed with PBST and the ELISA was developed according to the manufacturers instructions by the addition of 100 µl TMB substrate (Pierce). The reaction was stopped by the addition of 100 µl 2M $H_2SO_4$ and the absorbance at 405 nm was read on a SpectraMax M5 plate reader (Molecular Devices).

Example 22

Mouse Pharmacodynamic (PD) Analysis of Protease

A. Pharmacodynamics of CB450

Mice (n=6 for each dose) were injected intravenously with a bolus of CB450 at varying dosages ranging (0 mg/kg, 2.5 mg/kg, 5 mg/kg, 10 mg/kg, and 15 mg/kg). Plasma was collected from the treated mice at 5 minutes post-injection by cardiac puncture. Complement activity of the plasma samples from the different treatment groups were tested by hemolysis assay as described in Example 20 or by C3b deposition as determined by a C3b ELISA described in Example 21.

The results of the hemolysis experiment showed that there was a dose-dependent decreased hemolysis of erythrocytes induced by mouse plasma from CB450 treated mice as assessed by absorbance levels at 415 nm. Plasma samples from mice treated with no protease induced hemolysis in this assay as assessed by an absorbance at 415 nm of about 0.23, which decreased to about 0.1 in the 2.5 mg/kg CB450 treatment group with little to no detectable absorbance signal measured in samples from mice treated with 5, 20, or 15 mg/kg of CB450.

The C3b ELISA was performed using 1% or 10% plasma from each of the treatment groups. The fraction hemolysis from the no protease treated sample was set at 1.0 and the fraction hemolysis of all experimental samples was accordingly determined. Thus, for both the 1% and 10% plasma samples from mice treated with no protease, the fraction of C3b deposition was measured to be 1. The results of the C3b ELISA on the 10% plasma samples showed that the plasma from mice treated with increasing doses of CB450 showed no measurable difference in C3b levels at doses of CB450 of 2.5, 5, or 10 mg/kg as compared to the no protease treated sample, however, mice treated with 15 mg/kg exhibited a decreased fraction of C3b deposition which was measured to be about 0.40. The results of the C3b ELISA on the 1% plasma samples showed that plasma from mice treated with CB450 had a dose-dependent decrease in the fraction C3b deposition as compared to the no protease treated plasma sample, which was consistent with the results observed in the hemolysis experiment. Plasma samples from mice treated with 2.5 mg/kg CB450 exhibited a decreased C3b deposition which was measured to be about 0.40, while plasma from mice treated with 5, 20, or 15 mg/kg CB450 showed little to no detectable C3b.

B. Pharmacodynamics of a Panel of MT-SP1 Protease Mutants

Mice were injected intravenously with a bolus of increasing concentrations of a panel of MT-SP1 mutants including CB200 (wild-type), CB238, CB245, CB252, CB255, CB257, CB268, CB351, CB377, CB409, CB422, CB450, CB464, and CB473. Plasma was collected from the treated mice at 5 minutes post-injection by cardiac puncture. Complement activity of the plasma samples from the different treatment groups were tested by hemolysis assay as described in Example 19 or by C3b deposition as determined by a C3b ELISA (assayed in 1% and 10% plasma) as described in Example 20. The results were graphed as a function of protease concentration to determine the ED50 values. A summary of the results is depicted in Table 26 below. The Table also sets forth the maximum tolerated dose (MTD) of protease and the therapeutic index (TI) calculated as the ratio of MTD to ED50. The results show differences in the in vivo efficacy of some of the tested proteases.

TABLE 26

Mouse Pharmacodynamics

| PROTEASE | MTD (mg/kg) | Hemolysis (ED50; mg/kg) | Hemolysis TI | C3b in 1% plasma (ED50; mg/kg) | C3b TI (1% plasma) | C3b in 10% plasma (ED50; mg/kg) | C3b TI (10% plasma) |
|---|---|---|---|---|---|---|---|
| CB200 | 10 | 6.4 | 1.56 | 2.7 | 3.7 | 13.5 | 0.74 |
| CB238 | 15 | 9.4 | 1.6 | 6.1 | 2.46 | 16.2 | 0.92 |
| CB245 | 10 | 2.4 | 4.1 | 2.63 | 3.8 | >10 | 0 |
| CB252 | 12.5 | 5.7 | 2.19 | 3.8 | 3.29 | 9.9 | 1.26 |
| CB255 | 7 | 5 | 1.4 | 2.78 | 2.52 | >7 | 0 |
| CB257 | 5 | 3.1 | 1.6 | 4.86 | 1.03 | >5 | 0 |
| CB268 | 10 | 9.9 | 1 | 5.45 | 1.8 | >10 | 0 |
| CB351 | 10 | 6.6 | 1.52 | 5.8 | 1.72 | 10.8 | 0.93 |
| CB377 | 15 | 8.6 | 1.75 | 2.6 | 5.77 | 6.2 | 2.42 |
| CB409 | 15 | 8.2 | 1.8 | 3.2 | 4.65 | 17.99 | 0.83 |
| CB422 | 12.5 | 10.25 | 1.22 | 3.82 | 3.27 | 20.36 | 0.61 |
| CB450 | 15 | 1.8 | 8.5 | 3.5 | 4.3 | 15.9 | 0.9 |
| CB464 | 15 | 7.72 | 1.94 | 5.07 | 2.96 | 33.1 | 0.45 |
| CB473 | 12.5 | 14.25 | 0.86 | 1.95 | 6.41 | 8.01 | 1.56 |

Example 23

Rat Pharmacodynamic (PD) Analysis of Protease

A. CB252 and CB377

Rats were injected intravenously with a bolus of CB252 (23 mg/kg) followed by infusion for 1 hour at 3.3 mg/kg/hr or with a bolus of CB377 (18 mg/kg) followed by infusion for 1 hour at 1.8 mg/kg/hr. Rats treated with a vehicle control also were included in the study. Plasma was collected at various time points after injection (where t=0 is pre-injection; i.e. 0, 5, 15, 30, 60, or 120 minutes) and analyzed for complement activity by assaying for C2 cleavage by Western Blot as set forth in Example 9 (except that only 1.5 μl of plasma was used) and for hemolysis using the Cynomolgus hemolysis protocol as set forth in Example 19 using either 1% or 10% rat plasma.

The results showed increased cleavage of C2 in plasma from CB252 and CB377 treated rats. CB252 showed a greater cleavage of C2 as there was little detectable C2 present in the plasma samples as assessed by Western Blot even after only 5 minutes following injection, with no detectable C2 present at 60 or 120 minutes after injection. CB377 also showed diminished C2 levels as compared to vehicle control at early time points, however, by 60 minutes and 120 minutes the levels of C2 were comparable to those from vehicle control samples.

The results of hemolysis induced by 10% plasma from the treated rats showed that plasma from CB377 had no effect on the inhibition of hemolysis as compared to vehicle control, while plasma from CB252 showed a marked inhibition of hemolysis. Plasma samples from rats treated with CB252 collected at 5, 15, 30, and 60 minutes after injection showed little to no detectable hemolysis. Hemolysis was increased to levels comparable to vehicle control by plasma from CB252 treated mice at later time points (i.e. by 90 and 120 minutes).

The effects of CB252 and CB377 were more pronounced when hemolysis was induced by 1% plasma from each of the treated rats. The fraction hemolysis (set at 1.0 for the t=0 time point vehicle control sample) induced by 1% plasma from vehicle control rats did not change among the tested time points and was always around about 1.0. Plasma from rats treated with CB252 induced no detectable hemolysis at any of the collected time points. Plasma from CB377 treated rats also showed reduced hemolysis as compared to plasma from vehicle control treated animals at all time points, although to a lesser extent than plasma from CB252 treated rats. Hemolysis was reduced to the greatest extent in plasma collected 15 minutes after injection of CB377 with a reported fraction of hemolysis of about 0.2 as compared to plasma control treated mice, and steadily increased at longer time points after injection to about 0.6 at 120 minutes after injection.

B. Comparison of CB200, CB155, and CB42

Rats were injected intravenously with a bolus of CB200 (wildtype), CB155, and CB42 at 2 mg/kg, 10 mg/kg, and 25 mg/kg. Plasma was collected at various time points after injection (where t=0 is pre-injection) up to about 1380 minutes after injection and analyzed for complement activity by assaying for hemolysis using the Cynomolgus hemolysis protocol as set forth in Example 19 using 1% plasma. The results show that plasma from rats treated with CB200 or CB42 at 2 mg/kg and 10 mg/kg exhibited levels of hemolysis comparable to levels observed at t=0 before pre-injection of the protease. Plasma from rats treated with 25 mg/kg of CB200 or CB42 induced reduced hemolysis of erythrocytes at early time points, with little to no hemolysis observed at time points up to about 60 minutes after injection of the protease. Hemolysis was increased to levels comparable to hemolysis at t=0 before pre-injection of the protease from plasma samples collected by 1380 minutes after injection of CB200 or CB42. Plasma from CB155 treated rats, however, showed decreased hemolysis at all doses tested. Treatment of rats with 2 mg/kg or 10 mg/kg showed slight but reproducibly decreased hemolysis induced by plasma collected at early time points as compared to t=0 before pre-injection of the protease. Plasma samples collected at about 30 minutes after rats receiving a dosage of 2 mg/kg or 10 mg/kg of CB155 resulted in an observed OD415 of hemolysis of about 0.3 or about 0.25, respectively, as compared to about 0.45 for t=0 (no protease) plasma samples. Plasma collected at 240 minutes or longer after preinjection of CB155 at 2 mg/kg and 10 mg/kg induced hemolysis to levels comparable to that observed from t=0 treated animals. Plasma from rats treated with 25 mg/kg of CB155 induced reduced hemolysis of erythrocytes at early time points, with little to no hemolysis observed at timepoints up to about 240 minutes after injection of the protease. Hemolysis was increased to levels comparable to hemolysis at t=0 before pre-injection of the protease from plasma samples collected by 1380 minutes after injection of CB155. These results show that CB155 has a greater in vivo pharmacodynamic efficacy on complement inactivation than do CB200 and CB42 as assessed in this experiment.

Example 24

Cynomolgus Monkey Pharmacodynamic (PD) Analysis of Protease

A. CB252 Cynomolgus Ex Vivo Complement Inhibition

Two naive male and two naive female cynomolgus monkeys (approximately 2.2-4.4 kg, and 2-4 years of age at initiation of treatment) were assigned to a single treatment group. Each animal was permanently tattooed with a unique identification number and assigned to a 14-day acclimation period prior to dosing. Study animals were intravenously administered 1 and 3 mg/ml doses of CB252 at volumes of 5 mg/kg. Blood samples for ex vivo pharmacodynamic analyses were collected at scheduled time points (Pre-injection, i.e. t=0; 5 minutes, 30 minutes, and 60 minutes post-injection). Blood was collected by venipuncture from a peripheral vein of restrained, conscious animals. Blood samples were collected from spare animals to be used as baseline values. Approximately 1 ml of blood was transferred to a tube treated with lithium heparin, placed on ice, and then centrifuged at 2000 g for 15 minutes at 4° C. within 30 minutes of collection. Plasma obtained was divided into two approximately equal aliquots and then transferred to cyrovials which were frozen on dry ice. Samples were stored at approximately −60° C. or colder prior to thawing and analysis. Plasma samples were tested for effects on complement activation by assaying for C2 cleavage by Western Blot, C3b deposition by ELISA at 1% and 10% plasma concentration, and through hemolysis of sensitized chicken red blood cells at 1%, 2.5%, and 10% plasma.

1. C2 Cleavage

C2 cleavage in the plasma samples was assessed by Western Blot as described in Example 9 with the following modifications: 1 μl plasma, boiled with NuPAGE LDS sample buffer and sample reducing agent (Invitrogen) for 5 minutes, was used in the analysis; goat anti-human C2 was diluted to 1:2000 in 5% dry milk/TBST; and HRP-conjugated anti-goat secondary was diluted to 1:4000 in 5% dry milk/TBST. The results showed that ex vivo plasma from cynomolgus monkeys dosed with bolus IV injection of 1 or 3 mg/kg CB252 demonstrated partial cleavage of C2 at 3 mg/kg only. Plasma from monkeys treated with 1 mg/kg CB252 had no discernable C2 cleavage. In plasma collected from monkeys treated with 3 mg/kg CB252, there was a significant C2 cleavage observed for all three animals for which plasma samples were available. The average extent of degradation of C2 as determined by densitometry of C2 Western blots was 60% degraded at 5 minutes, 50% degraded at 30 minutes, and 40% degraded at 60 minutes.

The percent inhibition of complement as assessed by C2 cleavage in plasma from all animals treated with 3 mg/kg CB252 is summarized in Table 27 below.

TABLE 27

CB252 Ex Vivo Complement Inhibition: C2 cleavage

| Time point | Animal | | |
|---|---|---|---|
| | 2 | 4 | 5 |
| 5 minutes | 62% | 55% | 65% |
| 30 minutes | 55% | 45% | 50% |
| 60 minutes | 50% | 37% | 38% |

2. C3b Deposition

C3b deposition in the plasma samples was assessed by ELISA as described in Example 21. In the C3b deposition assay no significant inhibition of complement was observed in plasma samples from monkeys administered with 1 mg/kg CB252 administered for any animal at any time point assayed. At the 3 mg/kg dose of CB252, at 10% plasma, C3b deposition was inhibited by an average of approximately 50% at the 5 minute time point, 30% at the 30 minute time point, and 15% at 60 minutes. The level of inhibition by CB252 was observed to be greater when measured in 1% plasma. For the 3 mg/kg dose of CB252, at 1% plasma, C3b deposition was inhibited by an average of approximately 70% at 5 minutes, 55% at 30 minutes, and 50% at 60 minutes. The percent inhibition of complement as assessed by C3b deposition in plasma from all animals treated with 3 mg/kg CB252 are summarized in Table 28 below.

TABLE 28

CB252 Ex Vivo Complement Inhibition: C3b deposition

| Time point | 10% plasma Animal | | | 1% plasma Animal | | |
|---|---|---|---|---|---|---|
| | 2 | 4 | 5 | 2 | 4 | 5 |
| 5 minutes | 52% | 45% | 50% | 50% | 74% | 77% |
| 30 minutes | 37% | 38% | 13% | 25% | 60% | 40% |
| 60 minutes | 40% | 10% | 3% | 82% | 16% | 78% |

3. Hemolysis

Hemolysis was assessed in the sensitized chicken red blood cell (RBC) hemolysis assay as described in Example 19. The results showed that plasma from monkeys treated with 1 mg/kg dose of CB252 exhibited no observable effect on hemolysis of sensitized chicken RBC for any animal at any time point assayed. Plasma samples from monkeys treated with 3 mg/kg CB252 showed significant inhibition of hemolysis at the various time points assayed, and inhibition was observed at 1%, 2.5% and 10% plasma. In 10% plasma, plasma from monkeys treated with 3 mg/kg CB252 showed an average of 80% inhibition of hemolysis at 5 minutes, 45% inhibition at 30 minutes, and 25% inhibition at 60 minutes. In 2.5% plasma, plasma from monkeys treated with 3 mg/kg CB252 showed an average of 92% inhibition of hemolysis at 5 minutes, 80% inhibition at 30 minutes, and 65% inhibition at 60 minutes. In 1% plasma, plasma from monkeys treated with 3 mg/kg CB252 showed an average of 99% inhibition of hemolysis at 5 minutes, 98% inhibition at 30 minutes, and 90% inhibition at 60 minutes. The percent inhibition of complement as assessed by hemolysis of chicken RBCs by plasma from all animals treated with 3 mg/kg CB252 are summarized in Table 29 below.

TABLE 29

CB252 Ex Vivo Complement Inhibition: Hemolysis

| Time point (minutes) | 10% Plasma Animals | | | 2.5% Plasma Animals | | | 1% Plasma Animals | | |
|---|---|---|---|---|---|---|---|---|---|
| | 2 | 4 | 5 | 2 | 4 | 5 | 2 | 4 | 5 |
| 5 | 55% | 90% | 80% | 90% | 95% | 91% | 96% | 95% | 97% |
| 30 | 43% | 65% | 30% | 85% | 91% | 62% | 96% | 95% | 91% |
| 60 | ND | 40% | 10% | 98% | 78% | 21% | 96% | 91% | 79% |

ND: not determined

In summary, cynomolgus plasma from monkeys treated with a single bolus intravenous injection of 1 mg/kg CB252 did not show significant inhibition of complement as measured by C2 degradation, C3b deposition ELISA, or hemolysis of sensitized chicken red blood cells. Cynomolgus plasma from monkeys treated with a single bolus intravenous injection of 3 mg/kg CB252 did show significant inhibition of all ex vivo complement assays at the 5 minute and 30 minute time points. At the least stringent assay levels, 1% plasma in C3b deposition ELISA and 1% hemolysis, significant inhibition persists to the 60 minute time point.

B. Pharmacodynamic Efficacy of CB252 Compared to Other MT-SP1 Mutants in Cynomolgus Monkeys were injected intravenously with a bolus of CB252 or CB377 at 1 mg/kg and 3 mg/kg protease. Plasma was collected at various time points after injection (where t=0 is pre-injection; i.e. 0, 5, 30, and 60 minutes) and analyzed for complement activity by assaying for C2 cleavage by Western Blot as set forth in Example 9 and for hemolysis using the Cynomolgus hemolysis protocol as set forth in Example 19 using either 1%, 2.5% or 10% monkey plasma.

The results showed increased cleavage of C2 in plasma from CB252 and CB377 treated monkeys after treatment with 3 mg/kg protease but not after treatment with 1 mg/kg protease. Plasma collected from monkeys treated with 3 mg/kg CB252 and CB377 protease showed a time-dependent cleavage of C2, with greatest C2 cleavage occurring in plasma collected from monkeys at 5 minutes after protease treatment and decreased cleavage occurring at increased timepoints. The results also showed that a greater cleavage of C2 occurred in plasma collected from CB252 treated monkeys as compared to CB377 treated monkeys at all time points tested.

The results of the hemolysis experiment correlated with the C2 cleavage results since there was no observed difference in hemolysis induced by either 2.5% plasma or 10% plasma from monkeys treated with 1 mg/kg CB252 or CB377 protease at any of the collected time points as compared to hemolysis induced by plasma from monkeys not treated with protease (i.e. t=0). The results also showed that the hemolysis observed using either 2.5% or 10% plasma from monkeys treated with 3 mg/kg CB252 or CB377 was similar. Under both assay conditions, plasma from monkeys treated with 3 mg/kg CB377 showed only a slight decrease in hemolysis of erythrocytes as compared to plasma from t=0. The fraction of hemolysis at t=0 was set at 1.0 and the fraction hemolysis observed from plasma from CB377 treated monkeys was about 0.7 for all time points tested. CB252 was markedly more potent than CB377 in this experiment. Plasma from monkeys treated with 3 mg/kg CB252 collected 5 minutes after injection induced no detectable hemolysis of erythrocytes with an observed fraction hemolysis of at or close to 0. The effects of CB252 on hemolysis was time-dependent since the fraction hemolysis induced from plasma from monkeys treated with 3 mg/kg CB252 increased to about 0.4 and about 0.7 in plasma collected 30 minutes and 60 minutes, respectively, from CB252 treated monkeys.

In another experiment, the pharmacodynamic efficacy of proteases CB238, CB252, and CB377 was compared upon administration to Cynomolgus. Monkeys were injected intravenously with a bolus of CB238, CB252 or CB377 at the maximum tolerated dose (MTD) for each protease (i.e. 2 mg/kg, 3 mg/kg, and 3 mg/kg, respectively). Plasma was collected at various time points after injection (where t=0 is pre-injection; i.e. 0, 5, 30, and 60 minutes) and analyzed for complement activity by assaying for the ability to support hemolysis of chicken red blood cells using the Cynomolgus hemolysis protocol as set forth in Example 19 using either 2.5% or 10% monkey plasma. The % inhibition of hemolysis was determined as compared to hemolysis induced by 2.5% or 10% plasma collected from t=0 monkeys. The results are summarized in Table 30 below.

TABLE 30

Cynomolgus Pharmacodynamics

| Protease | Monkey MTD (mg/kg) | % inhib hemol (2.5% plasma) @ 5 min | % inhib hemol (2.5% plasma) @ 30 min | % inhib hemol (10% plasma) @ 5 min | % inhib hemol (10% plasma) @ 30 min |
|---|---|---|---|---|---|
| CB238 | 2 | 24 | 15 | 20 | 11 |
| CB252 | 3 | 92 | 79 | 75 | 46 |
| CB377 | 3 | 18 | 8 | 14 | 7 |

Example 25

Examination of the Complement-Mediated Cardiovascular Effects of Proteases Ex Vivo in Rabbit Hearts The effects of proteases on complement-mediated injury were assessed ex vivo using the Langendorff Assay to examine cardiac damage in rabbit hearts. Studies on the isolated heart allow for simultaneous observations of a compound's hemodynamic, electrocardiographic, and electrophysiologic effects. New Zealand White rabbits were used in this study because the amino acid sequence of the rabbit $IK_r$ channel shares 99% homology with the human $IK_r$ channel sequence (Wymore et al. (1997) Circ Res., 80: 261-268). The rabbit has been used extensively for cardiovascular studies and is an appropriate species to model potential effects on the human heart, since rabbit cardiac action potentials (similar to human cardiac action potentials) appear to be strongly driven by $IK_r$ (Weirich et al. (1998) Basic Res Cardiol., 93:125-132; Carmeliet et al. (1992) J Pharmacol Exp Ther., 262:809-817). Also, the interaction between human plasma and rabbit heart tissue has been previously characterized and has been shown to be primarily complement mediated (Kilgore et al. (1998) J Pharmacol Exp. Ther., 285: 987-94). For example, contact of human plasma and the foreign surface of the rabbit heart activates complement, which then mediates damage to the myocardium ultimately resulting in asystole. Therefore, this model is appropriate to determine the efficacy of complement inhibitors, such as proteases or modified proteases that target one or more complement components.

A. Experimental Design and Methods

Rabbits were euthanized via stunning followed by cardiectomy. Hearts were rapidly removed, mounted on a Langendorff apparatus, and perfused with modified, oxygenated, Krebs-Henseleit buffer (37° C.; Krebs-Henseleit buffer: 118.1 mM NaCl, 4.7 mM KCl, 1.17 mM $MgSO_4$, 1.18 mM $KH_2PO_4$, 11.1 mM d-glucose, 2.5 mM $CaCl_2$, 24.8 mM $NaHCO_3$, and 2.0 mM pyruvate; modified with the addition of 2.5 g of bovine serum albumin/1000 ml of perfusion medium; and oxygenated via pressurized oxygen/carbon dioxide (95%/5%)). A ventricular drain and fluid-filled latex balloon was secured in the left ventricle with a purse string suture at the atrial appendage. A pulmonary artery drain was secured. Hearts were paced via pacing electrodes placed onto the right atrium. Hearts were deemed acceptable for the study if they exhibited acceptable hemodynamic parameters (e.g., dP/dT>1000 mm Hg/sec) throughout the equilibration period.

The protease test compound (at a final concentration of 1 µM) was incubated with incubation media (containing human plasma diluted to 50% in perfusion buffer; i.e. 12 ml human serum diluted into 12 ml perfusion medium) for 1 hour at 37° C. Following the incubation, the test compound mixture was added to the experimental perfusion medium, recirculating, to give a final serum concentration of about 4-6% in 300 ml total volume. Isolated rabbit hearts that were previously equilibrated with perfusion medium for 10-15 minutes followed by collection of baseline measurements for 10 minutes, were exposed to perfusion medium containing the incubated test compound mixture for approximately 1 hour with measurements collected continuously as described below. The experiment was terminated if irreversible ventricular fibrillation occurred. Ventricular fibrillation was deemed irreversible if the heart did not spontaneously revert within 90 seconds of initiation. After exposure to the test compounds, the hearts were fixed in O.C.T., frozen on dry ice, and then stored in a freezer set at −80° C. for immunohistochemistry evaluation.

1. Hemodynamic Measurements

The latex balloon in the left ventricle (LV) was expanded with water to achieve an LV end-diastolic pressure (LVEDP) of approximately 5 mmHg. The balloon was connected with tubing to a pressure transducer to measure LEPD, LV diastolic pressure (LVDP) and LV systolic pressure (LVSP). Coronary perfusion was measured with a pressure transducer connected to a side-arm port of the aortic cannula. Hemodynamic measurements were continuously monitored with the Notocord HEM (Kalamazoo, Mich.) v3.5 data capture system. Digital markers were used to indicate test compound exposure periods. LVDP was defined as the difference between LVEDP and LVSP. Both maximal rate of increase in LV pressure (+dP/dt) and minimal rate of decrease in LV pressure (−dP/dt) were measured, as the first derivative of the time from LVEDP to LVSP and LVSP to LVEDP, respectively. Coronary perfusion pressure (CPP) also was measured.

Hemodynamic measurements from the final minute of the equilibration period (0 min) and during the last minute of each 15 minute period (i.e. 15 min, 30 min, 45 min, 60 min) within the hour of the test compound exposure period were evaluated and used to determine effects of the test compound. Average values taken from five consecutive cardiac cycles uninterrupted by interference of ectopic beats were used for analysis of hemodynamic parameters. Values from each individual heart were pooled to determine an average for each variable at individual concentrations. Average percent change of each variable between baseline and each concentration also was determined. The effect of each test compound on hemodynamic parameters was examined for statistical significance using repeated measures analysis of variance (ANOVA) followed by a post-hoc test for group comparisons when warranted. A value of $p<0.05$ was considered statistically significant. Data was presented as mean±SEM or percent change from baseline when appropriate.

2. Creatine Kinase Concentration Analysis

Approximately 2.0 ml of perfusion medium was collected just prior to the end of each 15 minute test period from the pulmonary artery drain. Prior to an early termination of the experiment (e.g., due to ventricular fibrillation), a sample was taken for analysis. The samples were frozen on dry ice, and then stored in a freezer set at −80° C. for analysis.

B. Experimental Results

One micromolar of CB200, CB155, or CB42 was preincubated with human plasma diluted to 50% in perfusion medium for 1 hour at 37° C. The protease test compound mixture was then diluted to a final concentration of 6% plasma and perfused over isolated rabbit hearts to induce complement activation and the effects of the proteases on complement activation was determined based on hemodynamic measurements. Perfusion of hearts with heat-inactivated plasma was used as a negative control. Maximal rate of increase in LV pressure (+dP/dt) was determined at baseline (0 min), and 15, 30, 45, and 60 minutes after perfusion with the test compound proteases. The results show that plasma alone induced reduced rate of increase in LV pressure indicating damage to the myocardium. The +dP/dt value was decreased about 5-fold from the baseline value and was similar between all time points tested. In contrast, plasma that was first heat-inactivated showed no change in the +dP/dt value as compared to that observed at baseline indicating no complement activation. Perfusion of rabbit hearts with protease test compounds protected the hearts from complement-mediated injury. Both CB42 and CB155 gave full protection of heart function as indicated by +dP/dt values comparable to baseline levels at all measured time points. CB200 (wildtype), however, only gave partial protection of heart function in this model. At 15 minutes after perfusion with CB200, the heart function observed indicated almost complete protection with +dP/dt value comparable to baseline levels. By 30 minutes, CB200 showed little to no protection of heart function with greater than 3-fold decreased values of +dP/dt observed, approaching the levels observed by treatment of rabbit hearts with plasma alone. The rate of increase in LV pressure levels in rabbits perfused in the presence of CB200 remained low at 45 and 60 minutes indicating cardiac damage at these time points.

Example 26

Expression and Purification of Modified MT-SP1 CB238 in Shake Flasks

CB238 and related recombinant MT-SP1 mutants or wildtype MT-SP1 were cloned and expressed in E. coli as inclusion bodies as described in Example 1 and 2 above. The production of the MT-SP1 or mutants was adapted for laboratory scale by optimizing production of the MT-SP1 mutant CB238 by pooling up to about 44×1 L shake flasks for subsequent isolation of the inclusion body pellets for solubilization and refolding. Briefly, 1 µl of plasmid DNA (from DNA miniprep purification) was mixed with 50 µl of BL-21 cells. The cells were incubated with the plasmid DNA on ice for 30 minutes, and then heat shocked at 42° C. for 45 seconds. The cells were then incubated on ice for 2 minutes for recovery. 500 µl of LB (LB; Difco LB Broth Lennox, approximate formulation per liter: 10.0 g Tryptone, 10.0 g Yeast Extract, 5.0 g Sodium Chloride) was added to the cells, and the culture was incubated at 37° C. with shaking for 1 hour. 50 µl of the cells was then plated out on agar plates containing 50 µg/ml carbenicillin for selection. The plate was incubated at 37° C. for 16-18 hours.

25 ml of LB containing 50 µg/ml carbenicillin was inoculated from a single colony and grown until fully confluent. 0.5 ml of the seed culture was added to 800 ml of 2XYT containing 10 µg/ml of carbenicillin and grown overnight (~12-16 hours; approximately 44 flasks). The cells were harvested by centrifugation at 6,000×g in a Sorvall rotor # SLC4000. The cell pellets were pooled and weighed. From 35.2 L of E. coli culture, 320 g of wet cell pellet was obtained. 600 ml of a buffer containing 50 mM Potassium Phosphate ($KPO_4$) pH 7.4 and 300 mM Sodium Chloride (NaCl) was added to the cell pellet. After the cells were completely resuspended, the batch was split into two and each part was sonicated in a glass vessel on ice. The sonicator was set at 60% duty cycle, output level 8, for 4 minutes. The sonication procedure was repeated two times for each sample. The resulting sonicated sample was centrifuged at 16,900×g for 20 minutes at 4° C. The supernatant was poured out and replaced with ~300 ml of fresh buffer containing 50 mM $KPO_4$ pH 7.4, 300 mM NaCl, and 0.5% lauryldimethylamine oxide (LDAO) volume/volume. The inclusion body was resuspended using a spatula and the solution was stirred until homogenous. The stirred sample was then centrifuged again and the supernatant decanted. The LDAO wash was performed a total of three times followed by three rounds of washing with buffer containing 50 mM $KPO_4$ pH 7.4, 300 mM NaCl that does not contain LDAO.

To the 70 g of purified wet inclusion body, 700 ml of denaturing buffer (6 M Guanidine HCl in 100 mM Tris pH 8.0, 20 mM dithiothreitol (DTT)) was added, and the protein was solubilized. The sample was then centrifuged at 20,400×g for 30 minutes at 22° C., and the supernatant was collected. The protein solution was then slowly dripped into 35 L of refolding solution (100 mM Tris pH 8.0, 150 mM NaCl, 1.5 M Arginine, 5 mM reduced glutathione, 0.05 mM oxidized glutathione) while vigorously stirring. The protein solution was left at 4° C. for 72 hrs.

The resulting protein solution was concentrated by hollow filtration to ~1-2 L then dialyzed into 16 L of buffer containing 50 mM Tris pH 8.0, 50 mM NaCl at 4° C. overnight. The buffer was exchanged for fresh buffer the following morning, and the sample was dialyzed for an additional 8 hours. The protease sample was then removed from the dialysis tubing and incubated at room temperature until auto-activation of the protease occurred by cleavage of the proregion to release the mature enzyme. Activity was monitored as described in Example 3 above using a fluorogenic RQAR-AMC substrate and SDS-PAGE. Upon complete activation, the sample was then dialyzed into buffer containing 50 mM HEPES pH 6.5 at 4° C. overnight.

The protein solution was then loaded onto a Source 15S column (Amersham) and eluted using a buffer gradient from 50 mM HEPES pH 6.5 to 50 mM HEPES pH 6.5 containing 0.15 M NaCl. Prior to all chromatography steps, each column is washed in reverse with 0.5 N NaOH then rinsed with water. The active fractions were pooled. An equal volume of buffer containing 2 M $(NH_4)_2SO_4$ in 50 mM $PO_4$ pH 7.0 was added, and the resulting solution was loaded onto a Phenyl Sepharose HP column pre-equilibrated with buffer containing 50 mM $PO_4$ pH 7.0, 1 M $(NH_4)_2SO_4$. The active protein was eluted with a buffer gradient from 50 mM $PO_4$ pH 7.0, 1 M $(NH_4)_2SO_4$ to 50 mM $PO_4$ pH 7.0. The active fractions were pooled and buffer exchanged into 50 mM HEPES pH 6.5. The sample was then reloaded and purified on Source 15Q as in the first chromatography step. Active fractions were then pooled, buffer exchanged into PBS using a stirred cell, and concentrated to ~10 mg/ml. A sample was removed to measure protein concentration, A280. Benzamidine was then added to a final concentration of 20 mM to the remaining sample prior to filtration of the protein sample through a 0.2 uM syringe filter. The protein solution was frozen in liquid nitrogen and stored at −80° C. The final yield was ~800 mg of pure protein (~20 mg of protease/L of culture). The purified protein was assayed for specific activity, purity, and endotoxin levels as described in Example 3 above.

A similar strategy was employed for other MT-SP1 mutants or wildtype MT-SP1. The protocol is altered depending on the specific mutant. For the mutants that don't purify well over Phenyl Sepharose, Benzamidine Sepharose was used instead. For example, the MT-SP1 mutant CB450 is purified over a Benzamidine column.

Example 27

Assessment of Hemolysis and Plasma Activity by a Panel of MT-SP1 Mutants

A panel of proteases was tested for their ability to support classical hemolysis or alternative hemolysis following preincubation with 20% plasma as described in Example 7, part A.1.b and Example 7, part B.1 above. In addition, the proteases were tested for Plasma Activity as described in Example 6. Table 31 depicts the fraction classical hemolysis at 200 nM, the fraction alternative hemolysis at 500 nM, and the IC50 for each protease for both Classical and Alternative hemolysis.

In addition, the percent protease unbound by alpha-2 macroglobulin (a2M) also was determined. Inactivation of a protease by alpha-2 macroglobulin traps the protease in a complex where it is still able to turn over small fluorescent substrates, but unable to access large protein substrates. This property of alpha-2 macroglobulin complicates the assessment of a proteases activity in plasma. To determine the actual activity of the free, uncomplexed protease in plasma, a two step measurement is required. First, the sample's activity on fluorescent substrates is measured. Second, a macromolecular inhibitor is added to bind all of the free protease (ATIII or M84R ecotin), and the protease activity trapped (and hence protected from inhibition) in alpha-2 macroglobulin is measured. The percent unbound by alpha-2 macroglobulin activity is the percentage of the plasma residual activity that is inhibited by the addition of the ecotin. Briefly, in a 0.2 mL PCR tube, 1 µL 10× protease was mixed with 9 µL human plasma in citrate (Innovative Research). An uninhibited control also was prepared containing 1 µL 10× protease mixed with 9 µL PBST. The mixtures were incubated for 5 minutes at 37° C. The samples were diluted 250 fold in PBST and stored on ice. Two 50 µL aliquots for each sample were transferred to an opaque assay plate (Costar #3694) containing 2 µL PBST or 2 µL 520 nM M84R ecotin. The plates were incubated 10 minutes at room temperature. Five microliters 0.4 mM Ac-RQAR-AMC substrate was added and the fluorescence was measured over time with a SpectraMax M5 spectrafluorometer (Molecular Devices) set to read every 20 seconds for 30 minutes at 30° C. (Ex: 380 nm, EM: 450 nm, Cut-off: 435 nm). The percent unbound by alpha-2 macroglobulin was calculated with the following formula: (1-([(Protease in plasma/Protease in PBST)−(Protease in plasma+ecotin/Protease in PBST)]/ (Protease in plasma/Protease in PBST)))*100. The results of % unbound alpha-2 macroglobulin for the panel of proteases tested is set forth in Table 31 below.

TABLE 31

Assessment of Hemolysis and Activity of a Panel of Proteases

| CB# | Mutations | Classical 200 nM Hemolysis | Alternative 500 nM Hemolysis | Classical $IC_{50}$ Hemolysis (nM) | Alternative $IC_{50}$ Hemolysis (nM) | Plasma Activity | % Unbound by a2M |
|---|---|---|---|---|---|---|---|
| CB421 | I41T/Y146D/Q175D/K224F | 0.714 | 478.90 | 0.271 | | 0.585 | 84% |
| CB422 | I41T/Y146E/Q175D/K224N | 0.050 | 50.35 | 0.150 | 111.8 | 0.511 | 83% |
| CB450 | I41T/I46D/G151L/K224F | 0.255 | 269.14 | 0.223 | 262.4 | 0.287 | |
| CB476 | I41T/Y146D/Q175D/K224L | 0.111 | 87.26 | 0.217 | 162.3 | 0.595 | 89% |
| CB477 | I41T/Y146D/Q175D/K224R | 0.016 | 53.43 | 0.140 | 116.2 | 0.346 | 67% |
| CB478 | I41T/Y146D/Q175D/K224N | 0.254 | 86.48 | 0.316 | 230.3 | 0.550 | 89% |
| CB480 | I41T/Y146D/G151L/Q175D/K224F | 0.272 | 131.01 | 0.367 | 268.1 | 0.670 | 88% |
| CB481 | I41T/Y146D/G151L/Q175D/K224L | 0.050 | 143.19 | 0.169 | 154.3 | 0.687 | 72% |
| CB482 | I41T/Y146D/G151L/Q175D/K224R | 0.042 | 57.39 | 0.255 | 296.2 | 0.306 | 10% |
| CB483 | I41T/Y146D/G151L/Q175D/K224N | 0.076 | 57.39 | 0.425 | 257.3 | 0.642 | 73% |
| CB484 | I41T/Y146E/Q175D/K224F | 0.235 | 67.21 | 0.365 | 268.5 | 0.649 | 94% |
| CB485 | I41T/Y146E/Q175D/K224L | 0.072 | 103.78 | 0.184 | 160.4 | 0.593 | 82% |
| CB486 | I41T/Y146E/Q175D/K224R | 0.014 | 43.36 | 0.128 | 125.4 | 0.326 | 44% |
| CB487 | I41T/Y146E/G151L/Q175D/K224N | 0.026 | 52.87 | 0.173 | 169.2 | 0.548 | 53% |
| CB488 | I41T/Y146E/G151L/Q175D/K224F | 0.086 | 72.61 | 0.195 | 179.3 | 0.658 | 85% |
| CB489 | I41T/Y146E/G151L/Q175D/K224L | 0.038 | 50.56 | 0.143 | 140.8 | 0.526 | 58% |
| CB490 | I41T/Y146E/G151L/Q175D/K224R | 0.031 | 52.63 | 0.125 | 193.8 | 0.288 | 0% |

Example 28

Additional Mutants

Additional mutants are prepared as described herein. Such mutants include, but are not limited to, those set forth in Table 32 below.

TABLE 32

Additional Mutants

| | SEQ ID | SEQ ID |
|---|---|---|
| I41T/Y146D/G151L/K224N | 681 | 696 |
| Y146D/Q175D/K224N | 682 | 697 |
| I41T/Y146D/K224N | 683 | 698 |
| Y146D/G151L/K224N | 684 | 699 |
| Y146D/Q175R/K224N | 685 | 700 |
| Y146D/Q175K/K224N | 686 | 701 |
| Y146D/Q175H/K224N | 687 | 702 |
| I41T/Y146D/G151L/Q175K/K224F | 688 | 703 |
| I41T/Y146D/G151L/Q175R/K224F | 689 | 704 |
| I41T/Y146D/G151L/Q175H/K224F | 690 | 705 |
| I41T/Y146D/G151L/Q175Y/K224F | 691 | 706 |
| I41T/Y146D/G151L/Q175K/K224N | 692 | 707 |
| I41T/Y146D/G151L/Q175R/K224N | 693 | 708 |
| I41T/Y146D/G151L/Q175H/K224N | 694 | 709 |
| I41T/Y146D/G151L/Q175Y/K224N | 695 | 710 |

SEQUENCE LISTING (726 sequences)

SEQ ID NO: 1 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 2 - protein, 855 aa, Homo sapiens [sequence omitted]

SEQ ID NO: 3 - DNA, 934 bp, Homo sapiens
tgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacaagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctctcccagtgtaaatctggagccaagtccagatttacactgggagaggtgccagcaactgaataaatacctcttagctgagtgg

SEQ ID NO: 4 - protein, 247 aa, Homo sapiens
MQPILLLLAFLLLPRADAGEIIGGHEAKPHSRPYMAYLMIWDQKSLKRCGGFLIQDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 5 - DNA, 1113 bp, Rattus norvegicus
cataagatgtatgtgtagggggtgtaagagtactcgtgaggggtgtgggcagtgttatagggtgctggtgagcaaaccctctgggacctaggtggccttccagggaagatgaagctcctcttgctcctgctgagcttctctctggcccccaagacagaggcaggggagatcatcgggggacatgaagccaagccccactctcgaccctacatggcctatcttcagatcatggatgagtattctgggagtaagaagtgtggcggcttccttatacgagaagactttgtgctgactgctgctcactgttcgggaagcaaaataaatgtcacgttgggggcccacaacatcaaagaacaggagaagatgcaacaaatcatccctgtggtgaaaatcattccccacccagcgtataattctaagacaatctccaatgacatcatgctgttaaagctgaagagtaaggccaagaggtctagcgctgtgaagcctctcaatctgcccagacgcaacgtcaaagtgaaaccaggagatgtgtgctatgtggctggttggggaaagctgggcccaatgggcaaatactcagacacactacaagaggttgagctaacagtacaggaggatcagaagtgtgagtcctacttaaaaaattatttcgacaaagccaatgagatatgtgcaggggacccaaagatcaaacgtgcttcctttcggggggactctggagggcctcttgtgtgtaaaaaagtggccgcgggcatcgtctcctatggacaaaatgatggttcaactccacgggcattcaccaaagtctcgactttcctatcatggataaagaaaactatgaaaaagagctaactacaagaagcaacatggatcatttcctgactaaccatctgccctatagctgagtccaggattgctctaggacagatggcagcaactgaataaagcactttttttctgagactggttgactggtttcatgtccattcacagtgatcaaccctgtccttggcagatgaatggaatgcttctgccacaaggctgtgacaacccagctgacatctgctagttcaccctctctacaagagaagaagaatgtttgattgtccg

SEQ ID NO: 6 - protein, 248 aa, Rattus norvegicus
MKLLLLLLSFSLAPKTEAGEIIGGHEAKPHSRPYMAYLQIMDEYSGSKKCGGFLIREDFVLTAAHCSGSKINVTLGAHNIKEQEKMQQIIPVVKIIPHPAYNSKTISNDIMLLKLKSKAKRSSAVKPLNLPRRNVKVKPGDVCYVAGWGKLGPMGKYSDTLQEVELTVQEDQKCESYLKNYFDKANEICAGDPKIKRASFRGDSGGPLVCKKVAAGIVSYGQNDGSTPRAFTKVSTFLSWIKKTMKKS

SEQ ID NO: 7 - DNA, 865 bp, Homo sapiens
ccctgccagcggcaccatggctttcctctggctcctctcctgctgggccctcctgggtaccaccttcggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggcgactctggcggtcccctggtctgccaaaaggatggagcctggaccctggtgggcattgtgtcctggggcagcgacacctgctccacctccagccctggcgtgtacgcccgtgtcaccaagctcataccttgggtgcagaagatcctggctgccaactgagcccgcggctccctccgaccctgctccccacagagcctcagtaaacccatggaacac

SEQ ID NO: 8 - protein, 263 aa, Homo sapiens
MAFLWLLSCWALLGTTFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSDTCSTSSPGVYARVTKLIPWVQKILAAN

SEQ ID NO: 9 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 10 - protein, 241 aa, Homo sapiens [sequence omitted]

SEQ ID NO: 11 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccaggacggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacttcccaggcgtgtacacaaggctccctctgtttcgggactggatcaaagagaacactggggta

SEQ ID NO: 12 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 13 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgcgtcggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 14 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCVGDSGGPLSSVEADGRIFQAGVVSWGDGCAQRNKPGVYTRLPLFRDWIKENTGV

SEQ ID NO: 15 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacgacaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 16 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDDTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 17 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacgagaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 18 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDETFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 19 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacgccaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 20 - protein, 241 aa, Homo spaiens
VVGGTDADEGEWPWQVSLHALGQGHICGASLISPNWLVSAAHCYIDDRGFRYSDPTQWTAFLGLHDQSQRSAPGVQERRLKRIISHPFFNDATFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 21 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 22 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 23 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccagaacggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 24 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQNGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 25 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccaggacggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 26 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 27 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccaggagggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 28 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 29 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccaggccggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 30 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQAGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 31 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtggggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 32 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQWGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 33 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccagaggggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 34 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQRGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 35 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccagaggggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccggggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 36 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQRGGTGALILQKGEIRVINQTTCENLLPQQITPRMMCVGFLSGGVDSCRGDSGGPLSSVEADGRIFQAGVVSWGDGCAQRNKPGVYTRLPLFRDWIKENTGV

SEQ ID NO: 37 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccagaggggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccggggtgattccgggggacccctgtccagcgtggaggcggatgggcggatcttccaggccggtgtggtgagctggggagacggctgcgctcagaggaacgcgccaggcgtgtacacaaggctccctctgtttcgggactggatcaaagagaacactggggta

SEQ ID NO: 38 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQRGGTGALILQKGEIRVINQTTCENLLPQQITPRMMCVGFLSGGVDSCRGDSGGPLSSVEADGRIFQAGVVSWGDGCAQRNAPGVYTRLPLFRDWIKENTGV

SEQ ID NO: 39 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccagaggggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccggggtgattccgggggacccctgtccagcgtggaggcggatgggcggatcttccaggccggtgtggtgagctggggagacggctgcgctcagaggaacttcccaggcgtgtacacaaggctccctctgtttcgggactggatcaaagagaacactggggta

SEQ ID NO: 40 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQRGGTGALILQKGEIRVINQTTCENLLPQQITPRMMCVGFLSGGVDSCRGDSGGPLSSVEADGRIFQAGVVSWGDGCAQRNFPGVYTRLPLFRDWIKENTGV

SEQ ID NO: 41 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPHQITPRMMCVGFLSGGVDSCQGDSGGPLSSVEADGRIFQAGVVSWGDGCAQRNKPGVYTRLPLFRDWIKENTGV

SEQ ID NO: 42 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGQGCAQRNKPGVYTRLPLFRDWIKENTGV

SEQ ID NO: 43 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGNGCAQRNKPGVYTRLPLFRDWIKENTGV

SEQ ID NO: 44 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGHGCAQRNKPGVYTRLPLFRDWIKENTGV

SEQ ID NO: 45 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNAFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 46 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNVFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 47 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNFFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 48 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNSFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 49 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNTFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 50 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCLGDSGGPLSSVEADGRIFQAGVVSWGDGCAQRNKPGVYTRLPLFRDWIKENTGV

SEQ ID NO: 51 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCIGDSGGPLSSVEADGRIFQAGVVSWGDGCAQRNKPGVYTRLPLFRDWIKENTGV

SEQ ID NO: 52 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCFGDSGGPLSSVEADGRIFQAGVVSWGDGCAQRNKPGVYTRLPLFRDWIKENTGV

SEQ ID NO: 53 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQFGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 54 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTADYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 55 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTVDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 56 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTSDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 57 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTGDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 58 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSFGDGCAQRNKPGVYTRLPLFRDWIKENTGV

SEQ ID NO: 59 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSYGDGCAQRNKPGVYTRLPLFRDWIKENTGV

SEQ ID NO: 60 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPAQITPRMMCVGFLSGGVDSCQGDSGGPLSSVEADGRIFQAGVVSWGDGCAQRNKPGVYTRLPLFRDWIKENTGV

SEQ ID NO: 61 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPVQITPRMMCVGFLSGGVDSCQGDSGGPLSSVEADGRIFQAGVVSWGDGCAQRNKPGVYTRLPLFRDWIKENTGV

SEQ ID NO: 62 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPFQITPRMMCVGFLSGGVDSCQGDSGGPLSSVEADGRIFQAGVVSWGDGCAQRNKPGVYTRLPLFRDWIKENTGV

SEQ ID NO: 63 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPRQITPRMMCVGFLSGGVDSCQGDSGGPLSSVEADGRIFQAGVVSWGDGCAQRNKPGVYTRLPLFRDWIKENTGV

SEQ ID NO: 64 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPKQITPRMMCVGFLSGGVDSCQGDSGGPLSSVEADGRIFQAGVVSWGDGCAQRNKPGVYTRLPLFRDWIKENTGV

SEQ ID NO: 65 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGAGCAQRNKPGVYTRLPLFRDWIKENTGV

SEQ ID NO: 66 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGVGCAQRNKPGVYTRLPLFRDWIKENTGV

SEQ ID NO: 67 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCEGDSGGPLSSVEADGRIFQAGVVSWGDGCAQRNKPGVYTRLPLFRDWIKENTGV

SEQ ID NO: 68 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTWDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 69 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTYDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 70 - DNA, 1165 bp, Homo sapiens
gctgggagtagagggcagagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaa

SEQ ID NO: 71 - protein, 314 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 72 - DNA, 1159 bp, Homo sapiens
gctgggagtagagggcagagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaa

SEQ ID NO: 73 - protein, 312 aa, Homo sapiens
MGARGALLLALLLARAGLRKPESQEAAPLSGPCGRRVITSRIVGGEDAELGRWPWQGSLRLWDSHVCGVSLLSHRWALTAAHCFETDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 74 - DNA, 1135 bp, Homo sapiens
gctgggagtagagggcagagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatgggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaaaaaaaaaaaaaa

SEQ ID NO: 75 - protein, 300 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMGDSGGPLACNKNGLWYQIGVVSWGVGCGRPNRPGVYTNISHHFEWIQKLMAQSGMSQPDPSWPLLFFPLLWALPLLGPV

SEQ ID NO: 76 - DNA, 1194 bp, Homo sapiens
ataaatggggaggggagagcccactgggtagaaggaacagggagcggccaggatgctgaatctgctgctgctggcgctgcccgtcctggcgagccgcgcctacgcggcccctgccccaggccaggccctgcagcgagtgggcatcgtcgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccctatcctgagcccccttccctgtcctaagcctgacgcctgcaccgggccctccagccctcccctgcccagatagctggtggtgggcgctaatcctcctgagtgctggacctcattaaagtgcatggaaatca

SEQ ID NO: 77 - protein, 275 aa, Homo sapiens
MLNLLLLALPVLASRAYAAPAPGQALQRVGIVGGQEAPRSKWPWQVSLRVHGPYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 78 - DNA, 1528 bp, Homo sapiens
ggaaggcacaggcctgagaagtctgcggctgagctgggagcaaatcccccaccccctacctgggggacagggcaagtgagacctggtgagggtggctcagcaggaagggaaggagaggtgtctgtgcgtcctgcacccacatctttctctgtcccctccttgccctgtctggaggctgctagactcctatcttctgaattctatagtgcctgggtctcagcgcagtgccgatggtggcccgtccttgtggttcctctctacctggggaaataaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaaaaaaaaaaaaaaaaaaaaaaaaaaaaaaaaaaa

SEQ ID NO: 79 - protein, 293 aa, Homo sapiens
MATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQCLNISVLSQKRCEDAYPRQIDDTMFCAGDKAGRDSCQGDSGGPVVCNGSLQGLVSWGDYPCARPNRPGVYTNLCKFTKWIQETIQANS

SEQ ID NO: 80 - DNA, 4942 bp, Homo sapiens
aaatcatccgtagtgcctccccgggggacacgtagaggagagaaaagcgaccaagataaaagtggacagaagaataagcgagactttttatccatgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtctgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgtgaagagctgcctgcagagagctgtacagaagcacttttcatggacagaaatgctcaatcgtgcactgcaaatttgcatgtttgttttggactaatttttttcaatttattttttcaccttcatttttctcttatttcaagttcaatgaaagactttacaaaagcaaacaaagcagactttgtccttttgccaggcctaaccatgactgcagcacaaaattatcgactctggcgagatttaaaatcaggtgctacagtaacaggttatggaatggtctcttttatcctatcacaaaaaaagacatagatatttaggctgattaattatctctaccagtttttgtttctcaagctcagtgcatagtggtaaatttcagtgttaacattggagacttgcttttctttttctttttttataccccacaattcttttttattacacttcgaattttagggtacacgagcacaacgtgcaggttagttacatatgtatacatgtgccatgttggtgtgctgaacccagtaactcgtcatttgatttattaaaagccaagataatttacatgtttaaagtatttactattacccccttctaatgtttgcataattctgagaactgataaaagacagcaataaaagaccagtgtcatccatttaggtagcaagacatattgaatgcaaagttctttagatatcaatattaacacttgacattattggaccccccattctggatgtatatcaagatcataattttatagaagagtctctatagaactgtcctcatagctgggtttgttcaggatatatgagttggctgattgagactgcaacaactacatctatatttatgggcaatattttgttttacttatgtggcaaagaactggatattaaactttgcaaaagagaatttagatgagagatgcaattttttaaaaagaaaattaatttgcatccctcgtttaattaaatttatttttcagttttcttgcgttcatccataccaacaaagtcataaagagcatattttagagcacagtaagactttgcatggagtaaaacattttgtaattttcctcaaaagatgtttaatatctggtttcttctcattggtaattaaaattttagaaatgatttttagctctaggccactttacgcaactcaatttctgaagcaattagtggtaaaaagtatttttccccactaaaaaactttaaaacacaaatcttcatatatacttaatttaattagtcaggcatccattttgccttttaaacaactaggattccctactaacctccaccagcaacctggactgcctcagcattccaaatagatactacctgcaattttatacatgtatttttgtatcttttctgtgtgtaaacatagttgaaattcaaaaagttgtagcaatttctatactattcatctcctgtccttcagtttgtataaacctaaggagagtgtgaaatccagcaactgaattgtggtcacgattgtatgaaagttcaagaacatatgtcagttttgttacagttgtagctacatactcaatgtatcaacttttagcctgctcaacttaggctcagtgaaatatatatattatacttattttaaataattcttaatacaaataaaatggtaatggtctaa

SEQ ID NO: 81 - protein, 1042 aa, Homo sapiens
MKQSPALAPEERCRRAGSPKPVLRADDNNMGNGCSQKLATANLLRFLLLVLIPCICALVLLLVILLSYVGTLQKVYFKSNGSEPLVTDGEIQGSDVILTNTIYNQSTVVSTAHPDQHVPAWTTDASLPGDQSHRNTSACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 82 - DNA, 945 bp, Homo sapiens
gcaggtaggtggacggagagatagcagcgacgaggacaggccaaacagtgacagccacgtagaggatctggcagacaaagagacaaggtgagaaggagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggaacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaactccactcttgttggcctgggaacttcttggaactttaactcctgccagcccttctaagacccacgagcggggtgagagaagtgtgcaatagtctggaataaatataaatgaaggaggggc

SEQ ID NO: 83 - protein, 254 aa, Homo sapiens
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRNPFPDLLQCLNLSIVSHATCHGVYPGRITSNMVCAGGVPGQDACQGDSGGPLVCGGVLQGLVSWGSVGPCGQDGIPGVYTYICNSTLVGLGTSWNFNSCQPF

SEQ ID NO: 84 - DNA, 1074 bp, Homo sapiens
gcaggtaggtggacggagagatagcagcgacgaggacaggccaaacagtgacagccacgtagaggatctggcagacaaagagacaaggtgagaaggagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggaacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggc

SEQ ID NO: 85 - protein, 248 aa, Homo sapiens
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRNPFPDLLQCLNLSIVSHATCHGVYPGRITSNMVCAGGVPGQDACQGDSGGPLVCGGVLQGLVSWGSVGPCGQDGIPGVYTYICKYVDWIRMIMRNN

SEQ ID NO: 86 - DNA, 814 bp, Homo sapiens
gcaggtaggtggacggagagatagcagcgacgaggacaggccaaacagtgacagccacgtagaggatctggcagacaaagagacaaggtgagaaggagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggc

SEQ ID NO: 87 - protein, 111 aa, Homo sapiens
MGLSIFLLLCVLGLSQAATPKIFNGTECGRNSQPWQVGLFEGTSLRCGGVLIDHRWVLTAAHCSGRPIPGSAPVPQPLHRLPCHLPWCVSRENHEQHGVCRRRPGAGCLPG

SEQ ID NO: 88 - DNA, 1471 bp, Homo sapiens
tgacttggatgtagacctcgaccttcacaggactcttcattgctggttggcaatgatgtatcggccagatgtggtgagggctaggaaaagagtttgttgggaaccctgggttatcggcctcgtcatcttcatatccctgattgtcctggcagtgtgcattggactcactgttcattatgtgagatataatcaaaagaagacctacaattactatagcacattgtcatttacaactgacaaactatatgctgagtttggcagagaggcttctaacaattttacagaaatgagccagagacttgaatcaatggtgaaaaatgcattttataaatctccattaagggaagaatttgtcaagtctcaggttatcaagttcagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcactcagttaaaattaaaaaaatcaacaagacagaaacagacagctatctaaaccattgctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcaaaaaaaaaa

SEQ ID NO: 89 - protein, 422 aa, Homo sapiens
MYRPDVVRARKRVCWEPWVIGLVIFISLIVLAVCIGLTVHYVRYNQKKTYNYYSTLSFTTDKLYAEFGREASNNFTEMSQRLESMVKNAFYKSPLREEFVKSQVIKFSQQKHGVLAHMLLICRFHSTEDPETVDKIVQLVLHEKLQDAVGPPKVDPHSVKIKKINKTETDSYLNHCCGTRRSKTLGQSLRIVGGTEVEEGEWPWQASLQWDGSHRCGATLINATWLVSAAHCFTTYKNPARWTASFGVTIKPSKMKRGLRRIIVHEKYKHPSHDYDISLAELSSPVPYTNAVHRVCLPDASYEFQPGDVMFVTGFGALKNDGYSQNHLRQAQVTLIDATTCNEPQAYNDAITPRMLCAGSLEGKTDACQGDSGGPLVSSDARDIWYLAGIVSWGDECAKPNKPGVYTRVTALRDWITSKTGI

SEQ ID NO: 90 - DNA, 1124 bp, Homo sapiens
ccatggcccttggggcctgtggcctcctgctgctcctggctgtgcccggtgtgtccctcaggactttgcagccagggtgtggccggccgcaggtttcggatgcaggcggccggatcgtggggggtcacgctgccccggccggcgcatggccatggcaggccagcctccgcctgcggaggatgcacgtgtgcggcgggtcactgctcagcccccagtgggtgctcacagctgcccactgcttctccgggtccctgaactcatccgactaccaggtgcacctgggggaactggagatcactttgtctccccacttctccaccgtgaggcagatcatcctgcactccagcccctcaggacagccggggaccagcggggacatcgccctggtggagctcagtgtccccgtgaccctctccagccggatcctgcccgtctgcctcccggaggcctcagatgacttctgccctgggatccggtgctgggtgaccggctggggctatacgcgggagggagagcctctgccacccccgtacagcctgcgggaggtgaaagtctccgtggtggacacagagacctgccgccgggactatcccggccccgggggcagcatccttcagcccgacatgctgtgtgcccggggccccggggatgcctgccaggacgactccggggggcctctggtctgccaggtgaacggtgcctgggtgcaggctggcattgtgagctggggtgagggctgcggccgccccaacaggccgggagtctacactcgtgtccctgcctacgtgaactggatccgccgccacatcacagcatcagggggctcagagtctgggtaccccaggctccccctcctggctggcttcttcctccccggcctcttccttctgctagtctcctgtgtcctgctggccaagtgcctgctgcacccatctgcggatggtactcccttccccgcccctgactgatggcaggaatccaagtgcatttcttaaataagttactatttattccgctccgccccctccctctcccttgagaagctgagtcttctgcatcagattattgcaacatttaacctgaatttaaaagcacacgaaacaaaaaaaaaaaaaaaaaaaaaa

SEQ ID NO: 91 - protein, 321 aa, Homo sapiens
MALGACGLLLLLAVPGVSLRTLQPGCGRPQVSDAGGRIVGGHAAPAGAWPWQASLRLRRMHVCGGSLLSPQWVLTAAHCFSGSLNSSDYQVHLGELEITLSPHFSTVRQIILHSSPSGQPGTSGDIALVELSVPVTLSSRILPVCLPEASDDFCPGIRCWVTGWGYTREGEPLPPPYSLREVKVSVVDTETCRRDYPGPGGSILQPDMLCARGPGDACQDDSGGPLVCQVNGAWVQAGIVSWGEGCGRPNRPGVYTRVPAYVNWIRRHITASGGSESGYPRLPLLAGFFLPGLFLLLVSCVLLAKCLLHPSADGTPFPAPD

SEQ ID NO: 92 - DNA, 1459 bp, Homo sapiens
gcacctagcagatcccaagctggggaatgccagttctggcaccaaccttcctgctccctgctggggcctctgctcccccatctctcaggagtcgaaagtgagaaagcaagacatcaaggagggacctgtgccctgctccacatcctcccacctgccgcccgcagagcctgcaggccccgcccccctcgtctctggtccctacctctctgctgtgtcttcatgtccctgagggtcttgggctctgggacctggccctcagcccctaaaatgttcctcctgctgacagcacttcaagtcctggctatagccatgacacagagccaagaggatgagaacaagataattggtggccatacgtgcacccggagctcccagccgtggcaggcggccctgctggcgggtcccaggcgccgcttcctctgcggaggcgccctgctttcaggccagtgggtcatcactgctgctcactgcggccgcccgatccttcaggttgccctgggcaagcacaacctgaggaggtgggaggccacccagcaggtgctgcgcgtggttcgtcaggtgacgcaccccaactacaactcccggacccacgacaacgacctcatgctgctgcagctacagcagcccgcacggatcgggagggcagtcaggcccattgaggtcacccaggcctgtgccagccccgggacctcctgccgagtgtcaggctggggaactatatccagccccatcgccaggtaccccgcctctctgcaatgcgtgaacatcaacatctccccggatgaggtgtgccagaaggcctatcctagaaccatcacgcctggcatggtctgtgcaggagttccccagggcgggaaggactcttgtcagggtgactctgggggacccctggtgtgcagaggacagctccagggcctcgtgtcttggggaatggagcgctgcgccctgcctggctaccccggtgtctacaccaacctgtgcaagtacagaagctggattgaggaaacgatgcgggacaaatgatggtcttcacggtgggatggacctcgtcagctgcccaggccctcctctctctactcaggacccaggagtccaggccccagcccctcctccctcagacccaggagtccaggcccccagcccctcctccctcagacccgggagtccaggcccccagcccctcctccctcagacccaggagccccagtccccagcatcctgatctttactccggctctgatctctcctttcccagagcagttgcttcaggcgttttctccccaccaagcccccacccttgctgtgtcaccatcactactcaagaccggaggcacagagggcaggagcacagaccccttaaaccggcattgtattccaaagacgacaatttttaacacgcttagtgtctctaaaaaccgaataaataatgacaataaaaatggaatcatcctaaattgta

SEQ ID NO: 93 - protein, 251 aa, Homo sapiens
MFLLLTALQVLAIAMTQSQEDENKIIGGHTCTRSSQPWQAALLAGPRRRFLCGGALLSGQWVITAAHCGRPILQVALGKHNLRRWEATQQVLRVVRQVTHPNYNSRTHDNDLMLLQLQQPARIGRAVRPIEVTQACASPGTSCRVSGWGTISSPIARYPASLQCVNINISPDEVCQKAYPRTITPGMVCAGVPQGGKDSCQGDSGGPLVCRGQLQGLVSWGMERCALPGYPGVYTNLCKYRSWIEETMRDK

SEQ ID NO: 94 - DNA, 3008 bp, Homo sapiens
cctgaatccttggagactgacatttttcccccctaaaggcatagacaacaaaagaaattttattgagaggaaaacacaagtccttaaactgcaaagatgtttgccaggatgtctgatctccatgttctgctgttaatggctctggtgggaaagacagcctgtgggttctccctgatgtctttattggaaagcctggacccagactggacccctgaccagtatgattacagctacgaggattataatcaggaagagaacaccagtagcacacttacccacgctgagaatcctgactggtactacactgaggaccaagctgatccatgccagcccaacccctgtgaacacggtggggactgcctcgtccatgggagcaccttcacatgcagctgcctggctcctttctctgggaataagtgtcagaaagtgcaaaatacgtgcaaggacaacccatgtggccggggccaatgtctcattacccagagtcctccctactaccgctgtgtctgtaaacacccttacacaggtcccagctgctcccaagtggttcctgtatgcaggccaaacccctgccagaatggggctacctgctcccggcataagcggagatccaagttcacctgtgcctgtcccgaccagttcaaggggaaattctgtgaaataggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcagaaacccagatgcggacgaaaagccctggtgctttattaaagttaccaatgacaaggtgaaatgggaatactgtgatgtctcagcctgctcagcccaggacgttgcctacccagaggaaagccccactgagccatcaaccaagcttccggggtttgactcctgtggaaagactgagatagcagagaggaagatcaagagaatctatggaggctttaagagcacggcgggcaagcacccatggcaggcgtccctccagtcctcgctgcctctgaccatctccatgccccagggccacttctgtggtggggcgctgatccacccctgctgggtgctcactgctgcccactgcaccgacataaaaaccagacatctaaaggtggtgctaggggaccaggacctgaagaaagaagaatttcatgagcagagctttagggtggagaagatattcaagtacagccactacaatgaaagagatgagattccccacaatgatattgcattgctcaagttaaagccagtggatggtcactgtgctctagaatccaaatacgtgaagactgtgtgcttgcctgatgggtcctttccctctgggagtgagtgccacatctctggctggggtgttacagaaacaggaaaagggtcccgccagctcctggatgccaaagtcaagctgattgccaacactttgtgcaactcccgccaactctatgaccacatgattgatgacagtatgatctgtgcaggaaatcttcagaaacctgggcaagacacctgccagggtgactctggaggccccctgacctgtgagaaggacggcacctactacgtctatgggatagtgagctggggcctggagtgtgggaagaggccaggggtctacacccaagttaccaaattcctgaattggatcaaagccaccatcaaaagtgaaagtggcttctaaggtactgtcttctggacctcagagcccactctccttggcaccctgacaccgggaggcctcatggccaacaatggacacctccagagcctccaggggaccacacagtagactatccctactctaagcagagacaactgccacccagcctgggccttcccagaccagcatttgcacaatatcaccaggcttcttctgcctcccttggtaacccaaggaatgatggaatcaacacaacatagtatgtttgctttccttacccaattgtaccttctagaaaatcagtgttcacagagactgcctccaccacaggcatcctgcaaatgcagactccagaatccccagcatcagcgggaaccaccatcacatctttattcctcagcccagacactcgaggcactcaacagaatcagccatccacgtctaggtatcagagaggaccacaaatacaacattctccatctgctttcagagttattattttaataaaggaagatctgggatgggctggtgggccattccagcttgccgaaatcaaagccatctgaagcctgtctctggtgaacaaacttcctctctggcctctcaggaatcagggtggcatggctcacaacagcagggccttcttctttttgacgtgcagaatctcagtggcatctgggttcacctccccactctgatgatctccagcctccactgcttctgccccccgctgctgaaatcaaacataccccaagttaaaatgaagctcccccacccccactcccggccccggttcccacaggacacgctaagaagcacagggagcatttaacaggctcaccctccctttccttttcccctcttctaccctccccaagaaaaagggccttcaaggcaggaatgagaaagcaaagccaatctctcatttagacctggcttctttcttctgaacaaagtagggttcaaaatgcagactgtcatatccagcgagtccctgaccctttctgcgaatgtaacgagcaagcagtcagcacagcctgggctgccctggcccgggattgatgtagccccggtaggtttgcctctgcagaactaatggctgtgacttcagagaaagccctgcaggaagtttaacctgcgtgtcatctgcctggtcatctcagacccatgaaattaggcgccttgtttgagctgcgtttcacacttctttagagctagctgacctttggccaaaaataaactttgaaaag

SEQ ID NO: 95 - protein, 560 aa, Homo sapiens
MFARMSDLHVLLLMALVGKTACGFSLMSLLESLDPDWTPDQYDYSYEDYNQEENTSSTLTHAENPDWYYTEDQADPCQPNPCEHGGDCLVHGSTFTCSCLAPFSGNKCQKVQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQDVAYPEESPTEPSTKLPGFDSCGKTEIAERKIKRIYGGFKSTAGKHPWQASLQSSLPLTISMPQGHFCGGALIHPCWVLTAAHCTDIKTRHLKVVLGDQDLKKEEFHEQSFRVEKIFKYSHYNERDEIPHNDIALLKLKPVDGHCALESKYVKTVCLPDGSFPSGSECHISGWGVTETGKGSRQLLDAKVKLIANTLCNSRQLYDHMIDDSMICAGNLQKPGQDTCQGDSGGPLTCEKDGTYYVYGIVSWGLECGKRPGVYTQVTKFLNWIKATIKSESGF

SEQ ID NO: 96 - DNA, 2124 bp, Homo sapiens
aatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctgtaagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggaaaaaaaaaaaaaaaa

SEQ ID NO: 97 - protein, 437 aa, Homo sapiens
MLQDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 98 - DNA, 1983 bp, Homo sapiens
aatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctgtaagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggaaaaaaaaaaaaaaaaaaaaaaaa

SEQ ID NO: 99 - protein, 335 aa, Homo sapiens
MDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGG

SEQ ID NO: 100 - DNA, 855 bp, Homo sapiens
aggcccacgatgctcctccttgctccccagatgctgagcctgctgctgctggcgctgcccgtcctggcgagcccggcctacgtggcccctgccccaggccaggccctgcagcaaacgggcattgttggggggcaggaggcccccaggagcaagtggccctggcaggtgagcctgagagtccgcggcccatactggatgcacttctgcgggggctccctcatccacccccagtgggtgctaaccgcggcgcactgcgtggaaccggacatcaaggatctggccgccctcagggtgcaactgcgggagcagcacctctactaccaggaccagctgctgccggtcagcaggatcatcgtgcacccacagttctacatcatccagaccggggcggacatcgccctgctggagctggaggagcccgtgaacatctccagccacatccacacggtcacgctgccccctgcctcggagaccttccccccggggatgccgtgctgggtcactggctggggcgacgtggacaataatgtgcacctgccgccgccatacccgctgaaggaggtggaagtccccgtagtggaaaaccacctttgcaacgcggaatatcacaccggcctccatacgggccacagctttcaaatcgtccgcgatgacatgctgtgtgcggggagcgaaaatcacgactcctgccagggtgactctggagggcccctggtctgcaaggtgaatggcacctaactgcaggcgggcgtggtcagctgggaggagagctgtgcccagcccaaccggcctggcatctacacccgtgtcacctactacttggactggatccaccactatgtccccaagaagccc

SEQ ID NO: 101 - protein, 242 aa, Homo sapiens
MLLLAPQMLSLLLLALPVLASPAYVAPAPGQALQQTGIVGGQEAPRSKWPWQVSLRVRGPYWMHFCGGSLIHPQWVLTAAHCVEPDIKDLAALRVQLREQHLYYQDQLLPVSRIIVHPQFYIIQTGADIALLELEEPVNISSHIHTVTLPPASETFPPGMPCWVTGWGDVDNNVHLPPPYPLKEVEVPVVENHLCNAEYHTGLHTGHSFQIVRDDMLCAGSENHDSCQGDSGGPLVCKVNGT

SEQ ID NO: 102 - DNA, 1462 bp, Homo sapiens
ctgtctcaaaaaattaaaaaaaataataataataataatgaatgaagctggacggacttcgcgtgcaccgcggtcagctcggggtctgctggggggtctgggtcagctcagggtccaggaaccgaggccaacggcaccccgtgctgcgctggggtgaggggtctgccctggggtctcggggttcagggctaggtcacggaggagtcggctctgggcgcttccttcctgaggagaggagctgggcaggccgggccgacgggttgggccgcatagccgggcctgtgctcatctccagcataaaactccacttcatggagcctgcacctcgctcgtgctccaacgcttctgccaccgccgaccacggccctgcgccccagccaggcctgaggacatgaggcggccggcggcggtgccgctcctgctgctgctgtgttttgggtctcagagggccaaggcagcaacagcctgtggtcgccccaggatgctgaaccgaatggtgggcgggcaggacacgcaggagggcgagtggccctggcaagtcagcatccagcgcaacggaagccacttctgcgggggcagcctcatcgcggagcagtgggtcctgacggctgcgcactgcttccgcaacacctctgagacgtccctgtaccaggtcctgctgggggcaaggcagctagtgcagccgggaccacacgctatgtatgcccgggtgaggcaggtggagagcaaccccctgtaccagggcacggcctccagcgctgacgtggccctggtggagctggaggcaccagtgcccttcaccaattacatcctccccgtgtgcctgcctgacccctcggtgatctttgagacgggcatgaactgctgggtcactggctggggcagccccagtgaggaagacctcctgcccgaaccgcggatcctgcagaaactcgctgtgcccatcatcgacacacccaagtgcaacctgctctacagcaaagacaccgagtttggctaccaacccaaaaccatcaagaatgacatgctgtgcgccggcttcgaggagggcaagaaggatgcctgcaagggcgactcgggcggccccctggtgtgcctcgtgggtcagtcgtggctgcaggcgggggtgatcagctggggtgagggctgtgcccgccagaaccgcccaggtgtctacatccgtgtcaccgcccaccacaactggatccatcggatcatccccaaactgcagttccagccagcgaggttgggcggccagaagtgagacccccggggccaggagccccttgagcagagctctgcacccagcctgcccgcccacaccatcctgctggtcctcccagcgctgctgttgcacctgtgagccccaccagactcatttgtaaatagcgctccttcctcccctctcaaatacccttattttatttatgtttctcccaataaaaacccagcctgtgtgcca

SEQ ID NO: 103 - protein, 290 aa, Homo sapiens
MRRPAAVPLLLLLCFGSQRAKAATACGRPRMLNRMVGGQDTQEGEWPWQVSIQRNGSHFCGGSLIAEQWVLTAAHCFRNTSETSLYQVLLGARQLVQPGPHAMYARVRQVESNPLYQGTASSADVALVELEAPVPFTNYILPVCLPDPSVIFETGMNCWVTGWGSPSEEDLLPEPRILQKLAVPIIDTPKCNLLYSKDTEFGYQPKTIKNDMLCAGFEEGKKDACKGDSGGPLVCLVGQSWLQAGVISWGEGCARQNRPGVYIRVTAHHNWIHRIIPKLQFQPARLGGQK

SEQ ID NO: 104 - DNA, 1755 bp, Homo sapiens
ccaggacttccgtctgagatgggatttctggacagaacaatggagcgcagaagctccagcaacgtgtgctctgcagggagcccagaccagagtccaagccctaggcagtgccacccttacccagcccagccttgaagacagaatgagaggggtttcctgtctccaggtcctgctccttctggtgctgggagctgctgggactcagggaaggaagtctgcagcctgcgggcagccccgcatgtccagtcggatcgttgggggccgggatggccgggacggagagtggccgtggcaggcgagcatccagcatcgtggggcacacgtgtgcggggggtcgctcatcgccccccagtgggtgctgacagcggcgcactgcttccccaggagggcactgccagctgagtaccgcgtgcgcctgggggcgctgcgtctgggctccacctcgccccgcacgctctcggtgcccgtgcgacgggtgctgctgcccccggactactccgaggacggggcccgcggcgacctggcactgctgcagctgcgtcgcccggtgcccctgagcgctcgcgtccaacccgtctgcctgcccgtgcccggcgcccgcccgccgcccggcacaccatgccgggtcaccggctggggcagcctccgcccaggagtgcccctcccagagtggcgaccgctacaaggagtaagggtgccgctgctggactcgcgcacctgcgacggcctctaccacgtgggcgcggacgtgccccaggctgagcgcattgtgctgcctgggagtctgtgtgccggctacccccagggccacaaggacgcctgccagggtgattctgggggacctctgacctgcctgcagtctgggagctgggtcctggtgggcgtggtgagctggggcaagggttgtgccctgcccaaccgtccaggggtctacaccagtgtggccacatatagcccctggattcaggctcgcgtcagcttctaatgctagccggtgaggctgacctggagccagctgctggggtccctcagcctcctggttcatccaggcacctgcctataccccacatcccttctgcctcgaggccaagatgcctaaaaaagctaaaggccaccccaccccccacccaccacctcctgcctcctctcctctttggggatcaccagctctgactccaccaaccctcatccaggaatctgccatgagtcccagggagtcacactccccactcccttcctggcttgtatttacttttcttggccctggccagggctgggcgcaaggcacgcagtgatgggcaaaccaattgctgcccatctggcctgtgtgcccatctttttctggagaaagtcagattcacagcatgacagagatttgacaccagggagatcctccatagctggctttgaggacacggggaccacagccatgagcggcctctaagagctgagagacagccggcagggaatcggaaccctcagacccacagccgcaaggcactggattctggcagcaccctgaaggagctgggaagtaagttcttccccagcctccagataagagccccgccggccaatcccttcatttcaacctaaagagaccctaagcagagaacctagctgagccactcctgacctacaaagttgtgacttaataaatgtgtgctttgaacccaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 105 - protein, 284 aa, Homo sapiens
MRGVSCLQVLLLLVLGAAGTQGRKSAACGQPRMSSRIVGGRDGRDGEWPWQASIQHPGAHVCGGSLIAPQWVLTAAHCFPRRALPAEYRVRLGALRLGSTSPRTLSVPVRRVLLPPDYSEDGARGDLALLQLRRPVPLSARVQPVCLPVPGARPPPGTPCRVTGWGSLRPGVPLPEWRPLQGVRVPLLDSRTCDGLYHVGADVPQAERIVLPGSLCAGYPQGHKDACQGDSGGPLTCLQSGSWVLVGVVSWGKGCALPNRPGVYTSVATYSPWIQARVTSNASR

SEQ ID NO: 106 - DNA, 321 bp, Homo sapiens
gcgctggtggcgggcggagtggagtccgcgcgcgggcgctggccatggcaggccagcctgcgcctgaggagacgccaccgatgtggagggagcctgctcagccgccgctgggtgctctcggctgcgcactgcttcgctccccagggtgactcaggtggacccttggtctgtgacaaggatggactgtggtatcaggttggaatcgtgagctggggaatggactgcggtcaacccaatcggcctggtgtctacaccaacatcagtgtgtacttccactggatccggagggtgatgtcccacagtacacccaggccaaacccc

SEQ ID NO: 107 - protein, 107 aa, Homo sapiens
ALVAGGVESARGRWPWQASLRLRRRHRCGGSLLSRRWVLSAAHCFAPQGDSGGPLVCDKDGLWYQVGIVSWGMDCGQPNRPGVYTNISVYFHWIRRVMSHSTPRPNP

SEQ ID NO: 108 - DNA, 2468 bp, Homo sapiens
accgggcaccggacggctcgggtactttcgttcttaattaggtcatgcccgtgtgagccaggaaagggctgtgtttatgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggagcaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgaggtggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctcaaaaaaaaaaaaaaaaaaaaaaaaaaaaaaa

SEQ ID NO: 109 - protein, 454 aa, Homo sapiens
MGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGAGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 110 - DNA, 2554 bp, Homo sapiens
gccacgttggattagggcccaccctaatgactcattttaactagatgactctgtaaagactctccaggccatctccaaataagatgccattctgaggtactaagagttaagacctcaacgtgtctttctgggggatactattcaacccatagcacatcccctcatcccccatggaataaccgggtcagaggtggagcaggtaggactgaactagagaatgtgccccttggtgggtggccctttccctaattaaggcacctttctttgggctgagacttctctgcaaagaggggagggggaaaggatagttaaatttgtaagtttcatggcactccaagtcaggttctggggctttctgctcttcctttttctggttatcagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggagcaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgaggtggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctcaaaaaaaaaaaaaaaaaaaaaaaaaaaaaaa

SEQ ID NO: 111 - protein, 327 aa, Homo sapiens
MCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGAGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 112 - DNA, 2135 bp, Homo sapiens
gcagggggacagttgttagtgttgcactctgaaagagctgttggttaattcctgccttcctcccttttcccagtccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggagcaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgaggtggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctcaaaaaaaaaaaaaaaaaaaaaaaaaaaaaaa

SEQ ID NO: 113 - protein, 327 aa, Homo sapiens; identical to SEQ ID NO: 111

SEQ ID NO: 114 - DNA, 1359 bp, Homo sapiens
accgggcaccggacggctcgggtactttcgttcttaattaggtcatgcccgtgtgagccaggaaagggctgtgtttatgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatggtacatctgggtctctatgtggttctgcagctcttcctttgtttcaagaggatttgcaattgctcattgaagcattcttatgatggctgctttataatccttgtcagatattaataattccaactcctgattcatgttggtgttggcatcagttgattatcttttctcattaaaattgtgatgctcctaaaaaaaaaaaaaaaaaa

SEQ ID NO: 115 - protein, 344 aa, Homo sapiens
MGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNGTSGSLCGSAALPLFQEDLQLLIEAFL

SEQ ID NO: 116 - DNA, 1191 bp, Homo sapiens
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 117 - protein, 121 aa, Homo sapiens
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQ

SEQ ID NO: 118 - DNA, 1172 bp, Homo sapiens
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 119 - protein, 161 aa, Homo sapiens
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQG

SEQ ID NO: 120 - DNA, 1054 bp, Homo sapiens
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 121 - protein, 171 aa, Homo sapiens
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQGDSGGPLVCGGILQGIVSWGDVPCDNTTKPGVYTKVCHYLEWIRETMKRN

SEQ ID NO: 122 - DNA, 1309 bp, Homo sapiens
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 123 - protein, 256 aa, Homo sapiens
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQVSLPDTLHCANISIISDTSCDKSYPGRLTNTMVCAGAEGRGAESCEGDSGGPLVCGGILQGIVSWGDVPCDNTTKPGVYTKVCHYLEWIRETMKRN

SEQ ID NO: 124 - DNA, 920 bp, Homo sapiens
cagacaggaggcgtctgtagagatatcatgaacttcaacttagctttgttttccagagactggagctaaactgggctttcaacatcatcatgaagtttatcctcctctgggccctcttgaatctgactgttgctttggcctttaatccagattacacagtcagctccactcccccttacttggtctatttgaaatctgactacttgccctgcgctggagtcctgatccacccgctttgggtgatcacagctgcacactgcaatttaccaaagcttcgggtgatattgggggttacaatcccagcagactctaatgaaaagcatctgcaagtgattggctatgagaagatgattcatcatccacacttctcagtcacttctattgatcatgacatcatgctaatcaagctgaaaacagaggctgaactcaatgactatgtgaaattagccaacctgccctaccaaactatctctgaaaataccatgtgctctgtctctacctggagctacaatgtgtgtgatatctacaaagagcccgattcactgcaaactgtgaacatctctgtaatctccaagcctcagtgtcgcgatgcctataaaacctacaacatcacggaaaatatgctgtgtgtgggcattgtgccaggaaggaggcagccctgcaaggaagtttctgctgccccggcaatctgcaatgggatgcttcaaggaatcctgtcttttgcggatggatgtgttttgagagccgatgttggcatctatgccaaaattttttactatataccctggattgaaaatgtaatccaaaataactgagctgtggcagttgtggaccatatgacacagcttgtccccatcgttcacctttagaattaaatataaattaactcctcaaaaaaaaaaaaaaaaaaaaaaaaaaaa

SEQ ID NO: 125 - protein, 241 aa, Homo sapiens
MKFILLWALLNLTVALAFNPDYTVSSTPPYLVYLKSDYLPCAGVLIHPLWVITAAHCNLPKLRVILGVTIPADSNEKHLQVIGYEKMIHHPHFSVTSIDHDIMLIKLKTEAELNDYVKLANLPYQTISENTMCSVSTWSYNVCDIYKEPDSLQTVNISVISKPQCRDAYKTYNITENMLCVGIVPGRRQPCKEVSAAPAICNGMLQGILSFADGCVLRADVGIYAKIFYYIPWIENVIQNN

SEQ ID NO: 126 - DNA, 2393 bp, Homo sapiens
cgcccgggcaggttgagaagccaggggccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggcacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctccctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggaggtaagatccctgcagcaggacactgcacccagcaggctgggaacttcctcaggtggggaccctggaggagcacccagggtgtaggcagaggtcccctcagcgtccccatattcggggggtgttctggacagggtcaaatgtgatgcctggggtcaatcccagctgtctgtgtttctttccctgcttttcttccctcagaacagagctcagcgggttgaaaaagggtggacctacaggccaggcaggcagttgctgggcagatgttctcccagaagtatttttttgtgtaaggttgcaatggactttgaaaacgtttcagtttctgcagaggattttgtgatagtctttgttatcaagcatttatgcatgggaatccgctcttcatggcctttcccagctctgtttgttttagtctttttgattttctttttgttgttgttgttgtctttttttaaaaacacaagtgactccattttaactctgacaactttcacagctgtcaccagaatgctccctgagaactaccattctttccctttcccacttaaaatatttcatcagaacctcaccactatcataaaagagtataaagtaataaaataataaaaagcgaaaaaaaaaaaaaaaaaaaaaaaaaaaaaaaa

SEQ ID NO: 127 - protein, 581 aa, Homo Sapiens
MERDSHGNASPARTPSAGASPAQASPAGTPPGRASPAQASPAQASPAGTPPGRASPAQASPAGTPPGRASPGRASPAQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRHKEQRESCPKHAVRCDGVVDCKLKSDELGCVRFDWDKSLLKIYSGSSHQWLPICSSNWNDSYSEKTCRQLGFESAHRTTEVAHRDFANSFSILRYNSTIQESLHRSHCPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLHGGRDSCQGDSGGPLVCEQNNRWYLAGVTSWGTGCGQRNKPGVYTKVTEVLPWIYSKMEVRSLQQDTAPSRLGTSSGGDPGGAPRV

SEQ ID NO: 128 - protein, 148 aa, Homo sapiens
CGKPKVVGKIYGGRDAAAGQWPWQASLLYWGSHLCGAVLIDSCWLVSTTHCFLNKSQAPKNYQVLLGNIQLYHQTQHTQKMSVHRIITHPDFEKLHPFGSDIAMLQLHLPMNFTSYIVPVCLPSRDMQLPSNVSCWITGWGMAILGGL

SEQ ID NO: 129 - DNA, 712 bp, Homo sapiens
cacagagggctccagcgtgattgccactggttaatgacctgccacccccgcccccccaacctctggtgccgtccaaggactctgaccccagtgcagtgtctgtagggaagaggagccatggggcttcgggcaggccccatcctgcttctgctgctgtggctgctgccagaatgcggccactccaaggaggccgggaggattgtgggaggccaagacacccaggaaggacgctggccgtggcaggttggcctgtggttgacctcagtggggcatgtatgtgggggcttcctcatccacccacgctgggtgctcacagccgcccactgcttcctgagggtgactccggggggccgctggtctgccccatcaatgatacgtggatccaggccggcattgtgagctggggattcggctgtgcccggcctttccggcctggtgtctacacccaggtgctaagctacacagactggattcagagaaccctggctgaatctcactcaggcatgtctggggcccgcccaggtgccccaggatcccactcaggcacctccagatcccacccagtgctgctgcttgagctgttgaccgtatgcttgcttgggtccctgtgaaccatgagccatggagtccgggatcccctttctggtaggattgatggaatctaataataaaaactgtaggttttttatgtgaaaaaaaaaaaaaaaaaaaa

SEQ ID NO: 130 - protein, 146 aa, Homo sapiens
MRPLQGGREDCGRPRHPGRTLAVAGWPVVDLSGACMWGLPHPPTLGAHSRPLLPEGDSGGPLVCPINDTWIQAGIVSWGFGCARPFRPGVYTQVLSYTDWIQRTLAESHSGMSGARPGAPGSHSGTSRSHPVLLLELLTVCLLGSL

SEQ ID NO: 131 - DNA, 800 bp, Homo sapiens
accaccatgaatccactcctgatccttacctttgtggcagctgctcttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggacgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaatagctaaagcccccagtatctcttcagtctctataccaataaagtgaccctgttctc

SEQ ID NO: 132 - protein, 247 aa, Homo sapiens
MNPLLILTFVAAALAAPFDDDDKIVGGYNCEENSVPYQVSLNSGYHFCGGSLINEQWVVSAGHCYKSRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 133 - DNA, 938 bp, Homo sapiens
gcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtagaaaaaaaaaaaaaaaa

SEQ ID NO: 134 - protein, 267 aa, Homo sapiens
MTLGRRLACLFLACVLPALLLGGTALASEIVGGRRARPHAWPFMVSLQLRGGHFCGATLIAPNFVMSAAHCVANVNVRAVRVVLGAHNLSRREPTRQVFAVQRIFENGYDPVNLLNDIVILQLNGSATINANVQVAQLPAQGRRLGNGVQCLAMGWGLLGRNRGIASVLQELNVTVVTSLCRRSNVCTLVRGRQAGVCFGDSGSPLVCNGLIHGIASFVRGGCASGLYPDAFAPVAQFVNWIDSIIQRSEDNPCPHPRDPDPASRTH

SEQ ID NO: 135 - DNA, 3895 bp, Homo sapiens
attccggcacagggacacaaacaagctcacccaacaaagccaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccactttctcaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaaaaaaaaaaaaaaaaaaaa

SEQ ID NO: 136 - protein, 728 aa, Homo sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPEGPAPHMLGLVAGWGISNPNVTVDEIISSGTRTLSDVLQYVKLPVVPHAECKTSYESRSGNYSVTENMFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 137 - DNA, 924 bp, Homo sapiens
gcacagcagcaactgactgggcagcctttcaggaaagatgcagccactcctgcttctgctggcctttctcctacccactggggctgaggcaggggagatcatcggaggccgggagagcaggccccactcccgcccctacatggcgtatcttcagatccagagtccagcaggtcagagcagatgtggagggttcctggtgcgagaagactttgtgctgacagcagctcattgctggggaagcaatataaatgtcaccctgggcgcccacaatatccagagacgggaaaacacccagcaacacatcactgcgcgcagagccatccgccaccctcaatataatcagcggaccatccagaatgacatcatgttattgcagctgagcagaagagtcagacggaatcgaaacgtgaacccagtggctctgcctagagcccaggagggactgagacccgggacgctgtgcactgtggccggctggggcagggtcagcatgaggaggggaacagatacactccgagaggtgcagctgagagtgcagagggataggcagtgcctccgcatcttcggttcctacgacccccgaaggcagatttgtgtgggggaccggcgggaacggaaggctgccttcaagggggattccggaggccccctgctgtgtaacaatgtggcccacggcatcgtctcctatggaaagtcgtcaggggttcctccagaagtcttcaccagggtctcaagtttcctgccctggataaggacaacaatgagaagcttcaaactgctggatcagatggagacccccctgtgactgactcttcttctcggggacacaggccagctccacagtgttgccagagccttaataaacgtccacagagtataaataaccaattcctcatttgttcattaaacgtcattcagtactta

SEQ ID NO: 138 - protein, 255 aa, Homo sapiens
MQPLLLLLAFLLPTGAEAGEIIGGRESRPHSRPYMAYLQIQSPAGQSRCGGFLVREDFVLTAAHCWGSNINVTLGAHNIQRRENTQQHITARRAIRHPQYNQRTIQNDIMLLQLSRRVRRNRNVNPVALPRAQEGLRPGTLCTVAGWGRVSMRRGTDTLREVQLRVQRDRQCLRIFGSYDPRRQICVGDRRERKAAFKGDSGGPLLCNNVAHGIVSYGKSSGVPPEVFTRVSSFLPWIRTTMRSFKLLDQMETPL

SEQ ID NO: 139 - DNA, 1001 bp, Homo sapiens
cgtgggtgcaccctggaccccaccatggctcaccggccccccagccctgccctggcgtccgtgctgctggccttgctgctgagcggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacataccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactcc

SEQ ID NO: 140 - protein, 256 aa, Homo sapiens
MAHRPPSPALASVLLALLLSGAARAAEIVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 141 - DNA, 878 bp, Homo sapiens
cagattttcaggttgattgatgtgggacagcagccacaatgaggaactcctatagatttctggcatcctctctctcagttgtcgtttctctcctgctaattcctgaagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaa

SEQ ID NO: 142 - protein, 262 aa, Homo sapiens
MRNSYRFLASSLSVVVSLLLIPEDVCEKIIGGNEVTPHSRPYMVLLSLDRKTICAGALIAKDWVLTAAHCNLNKRSQVILGAHSITREEPTKQIMLVKKEFPYPCYDPATREGDLKLLQLTEKAKINKYVTILHLPKKGDDVKPGTMCQVAGWGRTHNSASWSDTLREVNITIIDRKVCNDRNHYNFNPVIGMNMVCAGSLRGGRDSCNGDSGSPLLCEGVFRGVTSFGLENKCGDPRGPGVYILLSKKHLNWIIMTIKGAV

SEQ ID NO: 143 - DNA, 947 bp, Homo sapiens
ggctcggggccggggccagcacccacactgggtctccacagcggcatggaggcctgcgtgtcttcactgctggtgctggccctgggggccctgtcagtaggcagctcctttgggacccagatcatcgggggccgggaggtgatcccccactcgcgcccgtacatggcctcactgcagagaaatggctcccacctgtgcgggggtgtcctggtgcacccaaagtgggtgctgacggctgcccactgcctggcccagcggatggcccagctgaggctggtgctggggctccacaccctggacagccccggtctcaccttccacatcaaggcagccatccagcaccctcgctacaagcccgtccctgccctggagaacgacctcgcgctgcttcagctggacgggaaagtgaagcccagccggaccatccggccgttggccctgcccagtaagcgccaggtggtggcagcagggactcggtgcagcatggccggctgggggctgacccaccagggcgggcgcctgtcccgggtgctgcgggagctggacctccaagtgctggacacccgcatgtgtaacaacagccgcttctggaacggcagcctctcccccagcatggtctgcctggcggccgactccaaggaccaggctccctgcaagggtgactcgggcgggcccctggtgtgtggcaaaggccgggtgttggccggagtcctgtccttcagctccagggtctgcactgacatcttcaagcctcccgtggccaccgctgtggcgccttacgtgtcctggatcaggaaggtcaccggccgatcggcctgatgccctggggtgatggggaccccctcgctgtctccacaggacccttcccctccaggggtgcagtggggtgggtgaggacgggtgggagggacagggagggaccaataaatcataatgaagaaacgctc

SEQ ID NO: 144 - protein, 257 aa, Homo sapiens
MEACVSSLLVLALGALSVGSSFGTQIIGGREVIPHSRPYMASLQRNGSHLCGGVLVHPKWVLTAAHCLAQRMAQLRLVLGLHTLDSPGLTFHIKAAIQHPRYKPVPALENDLALLQLDGKVKPSRTIRPLALPSKRQVVAAGTRCSMAGWGLTHQGGRLSRVLRELDLQVLDTRMCNNSRFWNGSLSPSMVCLAADSKDQAPCKGDSGGPLVCGKGRVLAGVLSFSSRVCTDIFKPPVATAVAPYVSWIRKVTGRSA

SEQ ID NO: 145 - DNA, 784 bp, Homo sapiens
agcatttgctcaggcagcctctctgggaagatgctgcttcttcctctccccctgctgctctttctcttgtgctccagagctgaagctggggagatcatcgggggcacagaatgcaagccacattcccgcccctacatggcctacctggaaattgtaacttccaacggtccctcaaaattttgtggtggtttccttataagacggaactttgtgctgacggctgctcattgtgcaggaaggtctataacagtcacccttggagcccataacataacagaggaagaagacacatggcagaagcttgaggttataaagcaattccgtcatccaaaatataacacttctactcttcaccacgatatcatgttactaaagttgaaggagaaagccagcctgaccctggctgtggggacactccccttcccatcacaattcaactttgtcccacctgggagaatgtgccgggtggctggctggggaagaacaggtgtgttgaagccgggctcagacactctgcaagaggtgaagctgagactcatggatccccaggcctgcagccacttcagagactttgaccacaatcttcagctgtgtgtgggcaatcccaggaagacaaaatctgcatttaagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaatcctggatcc

SEQ ID NO: 146 - protein, 247 aa, Homo sapiens
MLLLPLPLLLFLLCSRAEAGEIIGGTECKPHSRPYMAYLEIVTSNGPSKFCGGFLIRRNFVLTAAHCAGRSITVTLGAHNITEEEDTWQKLEVIKQFRHPKYNTSTLHHDIMLLKLKEKASLTLAVGTLPFPSQFNFVPPGRMCRVAGWGRTGVLKPGSDTLQEVKLRLMDPQACSHFRDFDHNLQLCVGNPRKTKSAFKGDSGGPLLCAGVAQGIVSYGRSDAKPPAVFTRISHYRPWINQILQAN

SEQ ID NO: 147 - DNA, 1194 bp, Homo sapiens; identical to SEQ ID NO: 76

SEQ ID NO: 148 - protein, 275 aa, Homo sapiens; identical to SEQ ID NO: 77

SEQ ID NO: 149 - DNA, 1074 bp, Homo sapiens
gatcaacacatttcatctgggcttcttaaatctaaatctttaaaatgactaagttttcttccttttctctgtttttcctaatagttggggcttatatgactcatgtgtgtttcaatatggaaattattggagggaaagaagtgtcacctcattccaggccatttatggcctccatccagtatggcggacatcacgtttgtggaggtgttctgattgatccacagtgggtgctgacagcagcccactgccaatatcggtttaccaaaggccagtctcccactgtggttttaggcgcacactctctctcaaagaatgaggcctccaaacaaacactggagatcaaaaaatttataccattctcaagagttacatcagatcctcaatcaaatgatatcatgctggttaagcttcaaacagccgcaaaactcaataaacatgtcaagatgctccacataagatccaaaacctctcttagatctggaaccaaatgcaaggttactggctggggagccaccgatccagattcattaagaccttctgacaccctgcgagaagtcactgttactgtcctaagtcgaaaactttgcaacagccaaagttactacaacggcgacccttttatcaccaaagacatggtctgtgcaggagatgccaaaggccagaaggattcctgtaagggtgactcagggggccccttgatctgtaaaggtgtcttccacgctatagtctctggaggtcatgaatgtggtgttgccacaaagcctggaatctacaccctgttaaccaagaaataccagacttggatcaaaagcaaccttgtcccgcctcatacaaattaagttacaaataattttattggatgcacttgcttcttttttcctaatatgctcgcaggttagagttgggtgtaagtaaagcagagcacatatggggtccatttttgcacttgtaagtcattttattaaggaatcaagttctttttcacttgtatcactgatgtatttctaccatgctggttttattctaaataaaatttagaagactcaaaaaaaaaaaaaaaaaaaaaaaaaaaaa

SEQ ID NO: 150 - protein, 264 aa, Homo sapiens
MTKFSSFSLFFLIVGAYMTHVCFNMEIIGGKEVSPHSRPFMASIQYGGHHVCGGVLIDPQWVLTAAHCQYRFTKGQSPTVVLGAHSLSKNEASKQTLEIKKFIPFSRVTSDPQSNDIMLVKLQTAAKLNKHVKMLHIRSKTSLRSGTKCKVTGWGATDPDSLRPSDTLREVTVTVLSRKLCNSQSYYNGDPFITKDMVCAGDAKGQKDSCKGDSGGPLICKGVFHAIVSGGHECGVATKPGIYTLLTKKYQTWIKSNLVPPHTN

SEQ ID NO: 151 - DNA, 1047 bp, Homo sapiens
ggagtcaacaccaacagctctgacctgggcagccttcctgagaaaatgcagccattcctcctcctgttggcctttcttctgacccctggggctgggacagaggagatcatcgggggccatgaggccaagccccactcccgcccctacatggcctttgttcagtttctgcaagagaagagtcggaagaggtgtggcggcatcctagtgagaaaggactttgtgctgacagctgctcactgccagggaagctccataaatgtcaccttgggggcccacaatatcaaggaacaggagcggacccagcagtttatccctgtgaaaagacccatcccccatccagcctataatcctaagaacttctccaacgacatcatgctactgcagctggagagaaaggccaagtggaccacagctgtgcggcctctcaggctacctagcagcaaggcccaggtgaagccagggcagctgtgcagtgtggctggctggggttatgtctcaatgagcactttagcaaccacactgcaggaagtgttgctgacagtgcagaaggactgccagtgtgaacgtctcttccatggcaattacagcagagccactgagatttgtgtgggggatccaaagaagacacagaccggtttcaagggggactccggggggcccctcgtgtgtaaggacgtagcccaaggtattctctcctatggaaacaaaaaagggacacctccaggagtctacatcaaggtctcacacttcctgccctggataaagagaacaatgaagcgcctctaacagcaggcatgagactaaccttcctctgggcctgaccatctctgggacagaggcaagaatccccaaggggtgggcagtcagggttgcaggactgtaataaatggatctctggtgtagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 152 - protein, 246 aa, Homo sapiens
MQPFLLLLAFLLTPGAGTEEIIGGHEAKPHSRPYMAFVQFLQEKSRKRCGGILVRKDFVLTAAHCQGSSINVTLGAHNIKEQERTQQFIPVKRPIPHPAYNPKNFSNDIMLLQLERKAKWTTAVRPLRLPSSKAQVKPGQLCSVAGWGYVSMSTLATTLQEVLLTVQKDCQCERLFHGNYSRATEICVGDPKKTQTGFKGDSGGPLVCKDVAQGILSYGNKKGTPPGVYIKVSHFLPWIKRTMKRL

SEQ ID NO: 153 - DNA, 952 bp, Homo sapiens
ttggtccaagcaagaaggcagtggtctactccatcggcaacatgctggtcctttatggacacagcacccaggaccttccggaaaccaatgcccgcgtagtcggagggactgaggccgggaggaattcctggccctctcagatttccctccagtaccggtctggaggttcccggtatcacacctgtggagggacccttatcagacagaactgggtgatgacagctgctcactgcgtggattaccagaagactttccgcgtggtggctggagaccataacctgagccagaatgatggcactgagcagtacgtgagtgtgcagaagatcgtggtgcatccatactggaacagcgataacgtggctgccggctatgacatcgccctgctgcgcctggcccagagcgttaccctcaatagctatgtccagctgggtgttctgccccaggagggagccatcctggctaacaacagtccctgctacatcacaggctggggcaagaccaagaccaatgggcagctggcccagaccctgcagcaggcttacctgccctctgtggactacgccatctgctccagctcctcctactggggctccactgtgaagaacaccatggtgtgtgctggtggagatggagttcgctctggatgccagggtgactctgggggccccctccattgcttggtgaatggcaagtattctgtccatggagtgaccagctttgtgtccagccggggctgtaatgtctccaggaagcctacagtcttcacccaggtctctgcttacatctcctggataaataatgtcatcgcctccaactgaacattttcctgagtccaacgaccttcccaaaatggttcttagatctgcaataggacttgcgatcaaaaagtaaaacacattctgaaagactattgagccattgatagaaaagcaaataaaactagatatacatt

SEQ ID NO: 154 - protein, 258 aa, Homo sapiens
MLVLYGHSTQDLPETNARVVGGTEAGRNSWPSQISLQYRSGGSRYHTCGGTLIRQNWVMTAAHCVDYQKTFRVVAGDHNLSQNDGTEQYVSVQKIVVHPYWNSDNVAAGYDIALLRLAQSVTLNSYVQLGVLPQEGAILANNSPCYITGWGKTKTNGQLAQTLQQAYLPSVDYAICSSSSYWGSTVKNTMVCAGGDGVRSGCQGDSGGPLHCLVNGKYSVHGVTSFVSSRGCNVSRKPTVFTQVSAYISWINNVIASN

SEQ ID NO: 155 - DNA, 963 bp, Homo sapiens
tcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaattccaaaaaaaaaaaaaaaaaaaaaaaaaaaaaaaaaaaaaaaaaaaaaaaaaaaaaaaaaa

SEQ ID NO: 156 - protein, 270 aa, Homo sapiens
MMLRLLSSLLLVAVASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACGNDIALIKLSRSAQLGDAVQLASLPPAGDILPNKTPCYITGWGRLYTNGPLPDKLQQARLPVVDYKHCSRWNWWGSTVKKTMVCAGGYIRSGCNGDSGGPLNCPTEDGGWQVHGVTSFVSGFGCNFIWKPTVFTRVSAFIDWIEETIASH

SEQ ID NO: 157 - DNA, 914 bp, Homo sapiens
ttttacagaactcccacggacacaccatgataaggacgctgctgctgtccactttggtggctggagccctcagttgtggggaccccacttacccaccttatgtgactagggtggttggcggtgaagaagcgaggcccaacagctggccctggcaggtctccctgcagtacagctccaatggcaagtggtaccacacctgcggagggtccctgatagccaacagctgggtcctgacggctgcccactgcatcagctcctccaggacctaccgcgtggggctgggccggcacaacctctacgttgcggagtccggctcgctggcagtcagtgtctctaagattgtggtgcacaaggactggaactccaaccaaatctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcggtgattgcaaataactaaccaaaagaagtccctgggactgtttcagacttggaaaggtcacagaaggaaaataatataataaagtgacaactatgc

SEQ ID NO: 158 - protein, 269 aa, Homo sapiens
MIRTLLLSTLVAGALSCGDPTYPPYVTRVVGGEEARPNSWPWQVSLQYSSNGKWYHTCGGSLIANSWVLTAAHCISSSRTYRVGLGRHNLYVAESGSLAVSVSKIVVHKDWNSNQISKGNDIALLKLANPVSLTDKIQLACLPPAGTILPNNYPCYVTGWGRLQTNGAVPDVLQQGRLLVVDYATCSSSAWWGSSVKTSMICAGGDGVISSCNGDSGGPLNCQASDGRWQVHGIVSFGSRLGCNYYHKPSVFTRVSNYIDWINSVIANN

SEQ ID NO: 159 - DNA, 3696 bp, Homo sapiens
accagacagttcttaaattagcaagccttcaaaaccaaaaatggggtcgaaaagaggcatatcttctaggcatcattctctcagctcctatgaaatcatgtttgcagctctctttgccatattggtagtgctctgtgctggattaattgcagtatcctgcctgacaatcaaggaatcccaacgaggtgcagcacttggacagagtcatgaagccagagcgacatttaaaataacatccggagttacatataatcctaatttgcaagacaaactctcagtggatttcaaagttcttgcttttgaccttcagcaaatgatagatgagatctttctatcaagcaatctgaagaatgaatataagaactcaagagttttacaatttgaaaatggcagcattatagtcgtatttgaccttttctttgcccagtgggtgtcagatcaaaatgtaaaagaagaactgattcaaggccttgaagcaaataaatccagccaactggtcactttccatattgatttgaacagcgttgatatcctagacaagctaacaaccaccagtcatctggcaactccaggaaatgtctcaatagagtgcctgcctggttcaagtccttgtactgatgctctaacgtgtataaaagctgatttattttgtgatggagaagtaaactgtccagatggttctgacgaagacaataaaatgtgtgccacagtttgtgatggaagatttttgttaactggatcatctgggtctttccaggctactcattatccaaaaccttctgaaacaagtgttgtctgccagtggatcatacgtgtaaaccaaggactttccattaaactgagcttcgatgattttaatacatattatacagatatattagatatttatgaaggtgtaggatcaagcaagattttaagagcttctatttgggaaactaatcctggcacaataagaattttttccaaccaagttactgccacctttcttatagaatctgatgaaagtgattatgttggctttaatgcaacatatactgcatttaacagcagtgagcttaataattatgagaaaattaattgtaactttgaggatggcttttgtttctgggtccaggatctaaatgatgataatgaatgggaaaggattcagggaagcaccttttctccttttactggacccaattttgaccacacttttggcaatgcttcaggattttacatttctaccccaactggaccaggagggagacaagaacgagtggggcttttaagcctccctttggaccccactttggagccagcttgccttagtttctggtatcatatgtatggtgaaaatgtccataaattaagcattaatatcagcaatgaccaaaatatggagaagacagttttccaaaaggaaggaaattatggagacaattggaattatggacaagtaaccctaaatgaaacagttaaatttaaggttgcttttaatgcttttaaaaacaagatcctgagtgatattgcgttggatgacattagcctaacatatgggatttgcaatgggagtctttatccagaaccaactttggtgccaactcctccaccagaacttcctacggactgtggaggaccttttgagctgtgggagccaaatacaacattcagttctacgaactttccaaacagctaccctaatctggctttctgtgtttggattttaaatgcacaaaaaggaaagaatatacaacttcattttcaagaatttgacttagaaaatattaacgatgtagttgaaataagagatggtgaagaagctgattccttgctcttagctgtgtacacagggcctggcccagtaaaggatgtgttctctaccaccaacagaatgactgtgcttctcatcactaacgatgtgttggcaagaggagggtttaaagcaaactttactactggctatcacttggggattccagagccatgcaaggcagaccattttcaatgtaaaaatggagagtgtgttccactggtgaatctctgtgacggtcatctgcactgtgaggatggctcagatgaagcagattgtgtgcgttttttcaatggcacaacgaacaacaatggtttagtgcggttcagaatccagagcatatggcatacagcttgtgctgagaactggaccacccagatttcaaatgatgtttgtcaactgctgggactagggagtggaaactcatcaaagccaatcttctctaccgatggtggaccatttgtcaaattaaacacagcacctgatggccacttaatactaacacccagtcaacagtgtttacaggattccttgattcggttacagtgtaaccataaatcttgtggaaaaaaactggcagctcaagacatcaccccaaagattgttggaggaagtaatgccaaagaaggggcctggccctgggttgtgggtctgtattatggcggccgactgctctgcggcgcatctctcgtcagcagtgactggctggtgtccgccgcacactgcgtgtatgggagaaacttagagccatccaagtggacagcaatcctaggcctgcatatgaaatcaaatctgacctctcctcaaacagtccctcgattaatagatgaaattgtcataaaccctcattacaataggcgaagaaaggacaacgacattgccatgatgcatctggaatttaaagtgaattacacagattacatacaacctatttgtttaccggaagaaaatcaagtttttcctccaggaagaaattgttctattgctggttgggggacggttgtatatcaaggtactactgcaaacatattgcaagaagctgatgttcctcttctatcaaatgagagatgccaacagcagatgccagaatataacattactgaaaatatgatatgtgcaggctatgaagaaggaggaatagattcttgtcagggggattcaggaggaccattaatgtgccaagaaaacaacaggtggttccttgctggtgtgacctcatttggatacaagtgtgccctgcctaatcgccccggagtgtatgccagggtctcaaggtttaccgaatggatacaaagttttctacattagcgcatttcttaaactaaacaggaaagtcgcattattttcccattctactctagaaagcatggaaattaagtgtttcgtacaaaaattttaaaaagttaccaaaggtttttattcttacctatgtcaatgaaatgctagggggccagggaaacaaaattttaaaaataataaaattcaccatagcaatacagaataactttaaaataccattaaatacatttgtatttcattgtgaacaggtatttcttcacagatctcatttttaaaattcttaatgattatttttattacttactgttgtttaaagggatgttattttaaagcatataccatacacttaagaaatttgagcagaatttaaaaaagaaagaaaataaattgtttttcccaaagtatgtcactgttggaaataaactgccataaattttctagttccagtttagtttgctgctattagcagaaactcaattgtttctctgtcttttctatcaaaattttcaacatatgcataaccttagtattttcccaaccaatagaaactatttattgtaagcttatgtcacaggcctggactaaattgattttacgttcctctt

SEQ ID NO: 160 - protein, 1019 aa, Homo sapiens
MGSKRGISSRHHSLSSYEIMFAALFAILVVLCAGLIAVSCLTIKESQRGAALGQSHEARATFKITSGVTYNPNLQDKLSVDFKVLAFDLQQMIDEIFLSSNLKNEYKNSRVLQFENGSIIVVFDLFFAQWVSDQNVKEELIQGLEANKSSQLVTFHIDLNSVDILDKLTTTSHLATPGNVSIECLPGSSPCTDALTCIKADLFCDGEVNCPDGSDEDNKMCATVCDGRFLLTGSSGSFQATHYPKPSETSVVCQWIIRVNQGLSIKLSFDDFNTYYTDILDIYEGVGSSKILRASIWETNPGTIRIFSNQVTATFLIESDESDYVGFNATYTAFNSSELNNYEKINCNFEDGFCFWVQDLNDDNEWERIQGSTFSPFTGPNFDHTFGNASGFYISTPTGPGGRQERVGLLSLPLDPTLEPACLSFWYHMYGENVHKLSINISNDQNMEKTVFQKEGNYGDNWNYGQVTLNETVKFKVAFNAFKNKILSDIALDDISLTYGICNGSLYPEPTLVPTPPPELPTDCGGPFELWEPNTTFSSTNFPNSYPNLAFCVWILNAQKGKNIQLHFQEFDLENINDVVEIRDGEEADSLLLAVYTGPGPVKDVFSTTNRMTVLLITNDVLARGGFKANFTTGYHLGIPEPCKADHFQCKNGECVPLVNLCDGHLHCEDGSDEADCVRFFNGTTNNNGLVRFRIQSIWHTACAENWTTQISNDVCQLLGLGSGNSSKPIFSTDGGPFVKLNTAPDGHLILTPSQQCLQDSLIRLQCNHKSCGKKLAAQDITPKIVGGSNAKEGAWPWVVGLYYGGRLLCGASLVSSDWLVSAAHCVYGRNLEPSKWTAILGLHMKSNLTSPQTVPRLIDEIVINPHYNRRRKDNDIAMMHLEFKVNYTDYIQPICLPEENQVFPPGRNCSIAGWGTVVYQGTTANILQEADVPLLSNERCQQQMPEYNITENMICAGYEEGGIDSCQGDSGGPLMCQENNRWFLAGVTSFGYKCALPNRPGVYARVSRFTEWIQSFLH

SEQ ID NO: 161 - DNA, 917 bp, Homo sapiens
cagccagtcctgagcacctaaccatgttgggcatcactgtcctcgctgcgctcttggcctgtgcctccagctgtggggtgcccagcttcccgcccaacctatccgcccgagtggtgggaggagaggatgcccggccccacagctggccctggcagatctccctccagtacctcaagaacgacacgtggaggcatacgtgtggcgggactttgattgctagcaacttcgtcctcactgccgcccactgcatcagcaacacccggacctaccgtgtggccgtgggaaagaacaacctggaggtggaagacgaagaaggatccctgtttgtgggtgtggacaccatccacgtccacaagagatggaatgccctcctgttgcgcaatgatattgccctcatcaagcttgcagagcatgtggagctgagtgacaccatccaggtggcctgcctgccagagaaggactccctgctccccaaggactacccctgctatgtcaccggctggggccgcctctggaccaacggccccattgctgataagctgcagcagggcctgcagcccgtggtggatcacgccacgtgctccaggattgactggtggggcttcagggtgaagaaaaccatggtgtgcgctgggggcgatggcgtcatctcagcctgcaatggggactccggtggcccactgaactgccagttggagaacggttcctgggaggtgtttggcatcgtcagctttggctcccggcggggctgcaacacccgcaagaagccggtagtctacacccgggtgtccgcctacatcgactggatcaacgagaaaatgcagctgtgatttgttgctgggagcggcggcagcgagtccctgcaacagcaataaacttccttctcctcgggccacctgaaaaaaaaaaaaaaaaaa

SEQ ID NO: 162 - protein, 268 aa, Homo sapiens [sequence omitted]

SEQ ID NO: 163 - DNA, 1938 bp, Homo sapoens
gactttggtggcaagaggagctggcggagcccagccagtgggcggggccaggggaggggcgggcaggtaggtgcagccactcctgggaggaccctgcgtggccagacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcac

SEQ ID NO: 164 - protein, 343 aa, Homo sapiens
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 165 - DNA, 874 bp, Homo sapiens
agttcctccacctgctggcccctggacacctctgtcaccatgtggttcctggttctgtgcctcgccctgtccctgggggggactggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagatgctgtgaaggtcgtggagttgcccaccgaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatcc

SEQ ID NO: 166 - protein, 262 aa, Homo sapiens
MWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 167 - DNA, 2855 bp, Homo sapiens
agccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttaaaaaaaaaaaaaaaaaaaaa

SEQ ID NO: 168 - protein, 261 aa, Homo sapiens
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 169 - DNA, 2892 bp, Homo sapiens
agccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttaaaaaaaaaaaaaaaaaaaaa

SEQ ID NO: 170 - protein, 223 aa, Homo sapiens
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGVSHPYSQHLEGKG

SEQ ID NO: 171 - DNA, 2879 bp, Homo sapiens
agccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagtgagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttaaaaaaaaaaaaaaaaaaaaa

SEQ ID NO: 172 - protein, 164 aa, Homo sapiens
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEE

SEQ ID NO: 173 - DNA, 1464 bp, Homo sapiens
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 174 - protein, 261 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 175 - DNA, 1906 bp, Homo sapiens
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctagtcagagagtagtcctggaaggtggcctctgtgaggagccacggggacagcatcctgcagatggtcctggcccttgtcccaccgacctgtctacaaggactgtcctcgtggaccctcccctctgcacaggagctggaccctgaagtcccttccccaccggccaggactggagcccctacccctctgttggaatccctgcccaccttcttctggaagtcggctctggagacatttctctcttcttccaaagctgggaactgctatctgttatctgcctgtccaggtctgaaagataggattgcccaggcagaaactgggactgacctatctcactctctccctgcttttacccttagggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 176 - protein, 238 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSWVILITELTMPALPMVLHGSLVPWRGGV

SEQ ID NO: 177 - DNA, 1335 bp, Homo sapiens
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 178 - protein, 218 aa, Homo sapiens
MWVPVVFLTLSVTWIGAAPLILSRIVGGWECEKHSQPWQVLVASRGRAVCGGVLVHPQWVLTAAHCIRKPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 179 - DNA, 1341 bp, Homo sapiens
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 180 - protein, 220 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 181 - DNA, 555 bp, Homo sapiens
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagt

SEQ ID NO: 182 - protein, 69 aa, Homo sapiens
MWVPVVFLTLSVTWIGAAPLILSRIVGGWECEKHSQPWQVLVASRGRAVCGGVLVHPQWVLTAAHCIRK

SEQ ID NO: 183 - DNA, 807 bp, Homo sapiens
acactctaccaccatgaatccattcctgatccttgcctttgtgggagctgctgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccgcccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctc

SEQ ID NO: 184 - protein, 247 aa, Homo sapiens
MNPFLILAFVGAAVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTAPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 185 - DNA, 1055 bp, Homo sapiens
acctgcatttccaccacctgttctgggagtggggcccagtcagccccctttgcttaccttctgccctatattagagccccaggttctgtgcccttttcctatcatcgcaaaactcatgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagcggaagcttctaccacacctgtggcggtagcctcatcgcccccgactgggttgtgactgccggccactgcatctcgagctcccggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctccggctggtgacatccttcccaacgagacaccctgctacatcaccggctggggccgtctctataccaacgggccactcccagacaagctgcaggaggccctgctgccggtggtggactatgaacactgctccaggtggaactggtggggttcctccgtgaagaagaccatggtgtgtgctggaggggacatccgctccggctgcaatggtgactctggaggacccctcaactgccccacagaggatggtggctggcaggtccatggcgtgaccagctttgtttctgcctttggctgcaacacccgcaggaagcccacggtgttcactcgagtctccgccttcattgactggattgaggagaccatagcaagccactagaaccaaggcccagctggcagtgctgatcgatcccacatcctgaataaagaataaagatctctcagaaaattccaaaaaaaaaaaaaaaaaaaaaaaaaaaaaaaaaaaaaaaaaaaaaaaaaaaaaa

SEQ ID NO: 186 - protein, 270 aa, Homo sapiens
MMLRLLSSLLLVAVASGYGPPSSRPSSRVVNGEDAVPYSWPWQVSLQYEKSGSFYHTCGGSLIAPDWVVTAGHCISSSRTYQVVLGEYDRAVKEGPEQVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEETIASH

SEQ ID NO: 187 - DNA, 941 bp, Homo sapiens
cttacagaactcccacggacacaccatgattaggaccctgctgctgtccactttggtggctggagccctcagttgtggggtctccacttacgcgcctgatatgtctaggatgcttggaggtgaagaagcgaggcccaacagctggccctggcaggtctccctgcagtacagctccaatggccagtggtaccacacctgcggagggtccctgatagccaacagctgggtcctgacggctgcccactgcatcagctcctccgggatctaccgcgtgatgctgggccagcataacctctacgttgcagagtccggctcgctggccgtcagtgtctctaagattgtggtgcacaaggactggaactccgaccaggtctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctctccctgatgacctgaagcagggccggttgctggttgtggactatgccacctgctccagctctggctggtggggcagcaccgtgaagacgaatatgatctgtgctgggggtgatggcgtgatatgcacctgcaacggagactccggtgggccgctgaactgtcaggcatctgacggccggtgggaggtgcatggcatcggcagcctcacgtcggtccttggttgcaactactactacaagccctccatcttcacgcgggtctccaactacaacgactggatcaattcggtgattgcaaataactaaccaaaagaagtccctgggactgtttcagacttggaaaggtcacagaaggaaaataatattatataaagtgacaactatgcaaatcacaaaaaaaaaaaaaaaaaaa

SEQ ID NO: 188 - protein, 269 aa, Homo sapiens
MIRTLLLSTLVAGALSCGVSTYAPDMSRMLGGEEARPNSWPWQVSLQYSSNGQWYHTCGGSLIANSWVLTAAHCISSSGIYRVMLGQHNLYVAESGSLAVSVSKIVVHKDWNSDQVSKGNDIALLKLANPVSLTDKIQLACLPPAGTILPNNYPCYVTGWGRLQTNGALPDDLKQGRLLVVDYATCSSSGWWGSTVKTNMICAGGDGVICTCNGDSGGPLNCQASDGRWEVHGIGSLTSVLGCNYYYKPSIFTRVSNYNDWINSVIANN

SEQ ID NO: 189 - DNA, 2048 bp, Homo sapiens
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgaggaactcaataaagtgctttgaaaatgctgag

SEQ ID NO: 190 - protein, 615 aa, Homo sapiens
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGPFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 191 - DNA, 2245 bp, Homo sapiens
agaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccaataacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaacggaatgtggcgtttggtgggcatcacaagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaagacacagtgcactcagagctgctgaggacaatgtctgctgaagcccgctttcagcacgccgtaaccaggggctgacaatgcgaggtcgcaactgagatctccatgactgtgtgttgtgaaataaaatggtgaaagatc

SEQ ID NO: 192 - protein, 638 aa, Homo sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTNNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 193 - DNA, 2217 bp, Homo sapiens
tgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtcc

SEQ ID NO: 194 - protein, 625 aa, Homo sapiens
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISACNKDIYVDLDMKGINYNSSVAKSAQECQERCTDDVHCHFFTYATRQFPSLEHRNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 195 - DNA, 2055 bp, Homo sapiens
tgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtcc

SEQ ID NO: 196 - protein, 571 aa, Homo sapiens
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 197 - DNA, 2804 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 198 - protein, 461 aa, Homo sapiens
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 199 - DNA, 2478 bp, Homo sapiens
agtcccatggggaatgtcaacaggcaggggcagcactgcagagatttcatcatggtctcccaggccctcaggctcctctgccttctgcttgggcttcagggctgcctggctgcaggcggggtcgctaaggcctcaggaggagaaacacgggacatgccgtggaagccggggcctcacagagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtgctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagccccacctgcacgtgatctgctggccctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaagtgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccaccc

SEQ ID NO: 200 - protein, 466 aa, Homo sapiens
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 201 - DNA, 2412 bp, Homo sapiens
agtcccatggggaatgtcaacaggcaggggcagcactgcagagatttcatcatggtctcccaggccctcaggctcctctgccttctgcttgggcttcagggctgcctggctgcagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtgctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagccccacctgcacgtgatctgctggccctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaagtgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccaccc

SEQ ID NO: 202 - protein, 444 aa, Homo sapiens
MVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 203 - DNA, 1502 bp, Homo sapiens
cagggacacagtactcggccacaccatggggcgcccactgcacctcgtcctgctcagtgcctccctggctggcctcctgctgctcggggaaagtctgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacgaatgaattctggaataaatacaaagatggcgaccagtgtgagaccagtccttgccagaaccagggcaaatgtaaagacggcctcggggaatacacctgcacctgtttagaaggattcgaaggcaaaaactgtgaattattcacacggaagctctgcagcctggacaacggggactgtgaccagttctgccacgaggaacagaactctgtggtgtgctcctgcgcccgcgggtacaccctggctgacaacggcaaggcctgcattcccacagggccctacccctgtgggaaacagaccctggaacgcaggaagaggtcagtggcccaggccaccagcagcagcggggaggcccctgacagcatcacatggaagccatatgatgcagccgacctggaccccaccgagaaccccttcgacctgcttgacttcaaccagacgcagcctgagaggggcgacaacaacctcaccaggatcgtgggaggccaggaatgcaaggacggggagtgtccctggcaggccctgctcatcaatgaggaaaacgagggtttctgtggtggaaccattctgagcgagttctacatcctaacggcagcccactgtctctaccaagccaagagattcaaggtgagggtaggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtgagatcccactc

SEQ ID NO: 204 - protein, 488 aa, Homo sapiens
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 205 - DNA, 1997 bp, Homo sapiens
aattcctcagtgacccaggagctgacacactatggcgcacgtccgaggcttgcagctgcctggctgcctggccctggctgccctgtgtagccttgtgcacagccagcatgtgttcctggctcctcagcaagcacggtcgctgctccagcgggtccggcgagccaacaccttcttggaggaggtgcgcaagggcaacctagagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcacaaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtaggggccactcatattctgggctcctggaaccaatcccgtgaaagaattatttttgtgtttctaaaactatggttcccaataaaagtgactctcagcgg

SEQ ID NO: 206 - protein, 622 aa, Homo sapiens
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 207 - DNA, 1843 bp, Homo sapiens
ctgcaggggggggggggggggggggctgtcatggcggcaggacggcgaacttgcagtatctccacgacccgcccctacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcgaggtgagcttcctcaattgctcgctggacaacggcggctgcacgcattactgcctagaggaggtgggctggcggcgctgtagctgtgcgcctggctacaagctgggggacgacctcctgcagtgtcaccccgcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtggtcctgctggactcaaagaagaagctggcctgcggggcagtgctcatccacccctcctgggtgctgacagcggcccactgcatggatgagtccaagaagctccttgtcaggcttggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacgaaaaaaaaaaaaaaaaaaaaaaaaaaaaaaaaaaaaaaaacccccccccgccccccccccctgcag

SEQ ID NO: 208 - protein, 461 aa, Homo sapiens
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQREVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 209 - DNA, 1388 bp, Homo sapiens
caggcagtgcaggagtatggttgagatgctaccaactgccattctgctggtcttggcagtgtccgtggttgctaaagataacgccacgtgtgatggcccctgtgggttacggttcaggcaaaacccacagggtggtgtccgcatcgtcggcgggaaggctgcacagcatggggcctggccctggatggtcagcctccagatcttcacgtacaacagccacaggtaccacacatgtggaggcagcttgctgaattcacgatgggtgctcactgctgctcactgcttcgtcggcaaaaataatgtgcatgactggagactggttttcggagcaaaggaaattacatatgggaacaataaaccagtaaaggcgcctgtgcaagagagatatgtggagaaaatcatcattcatgaaaaatacaactctgcgacagagggaaatgacattgccctcgtggagatcacccctcccatttcgtgtgggcgcttcattgggccgggctgcctgccccacttgaaggcaggcctccccagaggctcccagagctgctgggtggccggctggggatatatagaagagaaagcccccaggccatcatctatactgatggaggcacgtgtggatctcatcgacctggacttgtgtaactcgacccagtggtacaatgggcgcgttcagccaaccaatgtgtgcgcggggtatcctgtaggcaagatcgacacctgccagggagacagcggcgggcctctcatgtgcaaagacagcaaggaaagcgcctatgtggtcgtgggaatcacaagctggggggtaggctgtgcccgtgccaagcgccccggaatctacacggccacctggccttatctgaactggatcgcctccaagattggttctaacgctttgcgtatgattcaatcggccacccctccaccgcccaccactcgaccgcccccgattcgaccccccttctcccaccctatctctgctcaccttccttggtatttccaaccgccccctcgaccacttccaccccgaccaccggcagcccagccccgacccccaccttcacccccgcccccacccccacctccagcctcacctttacccccacccccacccccacccccacctacaccctcatctaccacaaaacttccccaaggactttcttttgccaagcgcctacagcagctcatagaggtcttgaaggggaagacctattccgacggaaagaaccattatgacatggagaccacagagctcccagaactgacctcgacctcctgatctgacctggttctcaacagacccagtgagcccttcactcctgagaaaaaggaaagatgaaataaataaataaacatatatatatagatataaaaaaaaaaaaaaa

SEQ ID NO: 210 - protein, 421 aa, Homo sapiens
MVEMLPTAILLVLAVSVVAKDNATCDGPCGLRFRQNPQGGVRIVGGKAAQHGAWPWMVSLQIFTYNSHRYHTCGGSLLNSRWVLTAAHCFVGKNNVHDWRLVFGAKEITYGNNKPVKAPVQERYVEKIIIHEKYNSATEGNDIALVEITPPISCGRFIGPGCLPHLKAGLPRGSQSCWVAGWGYIEEKAPRPSSILMEARVDLIDLDLCNSTQWYNGRVQPTNVCAGYPVGKIDTCQGDSGGPLMCKDSKESAYVVVGITSWGVGCARAKRPGIYTATWPYLNWIASKIGSNALRMIQSATPPPPTTRPPPIRPPFSHPISAHLPWYFQPPPRPLPPRPPAAQPRPPPSPPPPPPPPASPLPPPPPPPPPTPSSTTKLPQGLSFAKRLQQLIEVLKGKTYSDGKNHYDMETTELPELTSTS

SEQ ID NO: 211 - DNA, 2363 bp, Homo sapiens
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtaaggacaagggcccccagactcacagttccagccctgaggacaggggttccctcatccccccacccagcctaatgcccacctcctaatagaggggttcctggggacctgaagagggggcactatgacgtctccccaagcacctaggtgttctgtcctgctcttccttcagactcagccgttggaccccagtcctttcctccccagacccaggagttccagccctcaggcccctcctccctcatactagggagtcctggcccccaaattcctcctttcccaagacttatgatttcaggtcctcagctgtctcctccctcaaaccgggatcctcagtcccctgctccaccaggctcaggcatgggggtccccatccctgcaaatccaggcgtccccccgctgctggtcagacactgaccccatccttgaacccagcccaatctgcgtccgtgatcacggcgtgctctggccaaggcccagtccctacagcctgcctggatggacgcctgggactgggggcgccaggactgggctgggctgggctcccccaggccctgcctccccgtccatctcctcacaggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgatt

SEQ ID NO: 212 - protein, 417 aa, Homo sapiens
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 213 - DNA, 1783 bp, Homo sapiens
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgatt

SEQ ID NO: 214 - protein, 417 aa, Homo sapiens; identical to SEQ ID NO: 212

SEQ ID NO: 215 - DNA, 2038 bp, Homo sapiens
gccatggggcgctgggcctgggtccccagcccctggcccccaccggggctgggccccttcctcctcctcctcctgctgctgctgctgctgccacgggggttccagccccagcctggcgggaaccgtacggagtccccagaacctaatgccacagcgacccctgcgatccccactatcctggtgacctctgtgacctctgagaccccagcaacaagtgctccagaggcagagggaccccaaagtggggggctcccgcccccgcccagggcagttccctcgagcagtagcccccaggcccaagcactcaccgaggacgggaggccctgcaggttccccttccgctacgggggccgcatgctgcatgcctgcacttcggagggcagtgcacacaggaagtggtgtgccacaactcacaactacgaccgggacagggcctggggctactgtgtggaggccaccccgcctccagggggcccagctgccctggatccctgtgcctccggcccctgcctcaatggaggctcctgctccaatacccaggacccccagtcctatcactgcagctgcccccgggccttcaccggcaaggactgcggcacagagaaatgctttgatgagacccgctacgagtacctggaggggggcgaccgctgggcccgcgtgcgccagggccacgtggaacagtgcgagtgcttcgggggccggacctggtgcgaaggcacccgacatacagcttgtctgagcagcccttgcctgaacgggggcacctgccacctgatcgtggccaccgggaccaccgtgtgtgcctgcccaccaggcttcgctggacggctctgcaacatcgagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggaatccggacaatgacgagaggccctggtgctacgtggtgaaggacagcgcgctctcctgggagtactgccgcctggaggcctgcgaatccctcaccagagtccaactgtcaccggatctcctggcgaccctgcctgagccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtccacacctgctgggtggtgtcggccgcccactgcttctcccacagcccccccagggacagcgtctccgtggtgctgggccagcacttcttcaaccgcacgacggacgtgacgcagaccttcggcatcgagaagtacatcccgtacaccctgtactcggtgttcaaccccagcgaccacgacctcgtcctgatccggctgaagaagaaaggggaccgctgtgccacacgctcgcagttcgtgcagcccatctgcctgcccgagcccggcagcaccttccccgcaggacacaagtgccagattgcgggctggggccacttggatgagaacgtgagcggctactccagctccctgcgggaggccctggtccccctggtcgccgaccacaagtgcagcagccctgaggtctacggcgccgacatcagccccaacatgctctgtgccggctacttcgactgcaagtccgacgcctgccagggggactcaggggggcccctggcctgcgagaagaacggcgtggcttacctctacggcatcatcagctggggtgacggctgcgggcggctccacaagccgggggtctacacccgcgtggccaactatgtggactggatcaacgaccggatacggcctcccaggcggcttgtggctccctcctgaccctccagcgggacaccctggttcccaccattccctgccttgctgacaataaagatatttccaagaa

SEQ ID NO: 216 - protein, 655 aa, Homo sapiens
MGRWAWVPSPWPPPGLGPFLLLLLLLLLLPRGFQPQPGGNRTESPEPNATATPAIPTILVTSVTSETPATSAPEAEGPQSGGLPPPPRAVPSSSSPQAQALTEDGRPCRFPFRYGGRMLHACTSEGSAHRKWCATTHNYDRDRAWGYCVEATPPPGGPAALDPCASGPCLNGGSCSNTQDPQSYHCSCPRAFTGKDCGTEKCFDETRYEYLEGGDRWARVRQGHVEQCECFGGRTWCEGTRHTACLSSPCLNGGTCHLIVATGTTVCACPPGFAGRLCNIEPDERCFLGNGTGYRGVASTSASGLSCLAWNSDLLYQELHVDSVGAAALLGLGPHAYCRNPDNDERPWCYVVKDSALSWEYCRLEACESLTRVQLSPDLLATLPEPASPGRQACGRRHKKRTFLRPRIIGGSSSLPGSHPWLAAIYIGDSFCAGSLVHTCWVVSAAHCFSHSPPRDSVSVVLGQHFFNRTTDVTQTFGIEKYIPYTLYSVFNPSDHDLVLIRLKKKGDRCATRSQFVQPICLPEPGSTFPAGHKCQIAGWGHLDENVSGYSSSLREALVPLVADHKCSSPEVYGADISPNMLCAGYFDCKSDACQGDSGGPLACEKNGVAYLYGIISWGDGCGRLHKPGVYTRVANYVDWINDRIRPPRRLVAPS

SEQ ID NO: 217 - DNA, 2360 bp, Homo sapiens
acagtgcggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatgaaaaaaaaaaaaaaa

SEQ ID NO: 218 - protein, 431 aa, Homo sapiens
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 219 - DNA, 2653 bp, Homo sapiens
atggccctgtccactgagcatcctcccgccacacagaaacccgcccagccggggccaccgaccccaccccctgcctggaaacttaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcc

SEQ ID NO: 220 - protein, 562 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 221 - DNA, 2160 bp, Homo sapiens
atggccctgtccactgagcatcctcccgccacacagaaacccgcccagccggggccaccgaccccaccccctgcctggaaacttaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaaaaaaaaaaaaaaaaaaa

SEQ ID NO: 222 - protein, 291 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRTGRSVSSPATASMRPCLLSIRSG

SEQ ID NO: 223 - DNA, 2534 bp, Homo sapiens
atggccctgtccactgagcatcctcccgccacacagaaacccgcccagccggggccaccgaccccaccccctgcctggaaacttaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaaggttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaaaaaaaaaaaaaaaaa

SEQ ID NO: 224 - protein, 516 aa, Homo sapiens
MDAMKRGLCCVLLLCGAVFVSPSQEIHARFRRGARSYQGCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 225 - DNA, 2732 bp, Homo sapiens
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgcgacatcccccgctgcacaacacctccaccatcttctggtcccacctaccagtgtctgaagggaacaggtgaaaactatcgcgggaatgtggctgttaccgtttccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtgggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggaggtcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggtttt

SEQ ID NO: 226 - protein, 810 aa, Homo sapiens
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 227 - DNA, 1527 bp, Homo sapiens
ggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgaaaaaaaaaaaaaaaa

SEQ ID NO: 228 - protein, 244 aa, Homo sapiens
MKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 229 - DNA, 1527 bp, Homo sapiens
aggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatg

SEQ ID NO: 230 - protein, 244 aa, Homo sapiens; identical to SEQ ID NO: 228

SEQ ID NO: 231 - DNA, 1495 bp, Homo sapiens
aggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggaggcccggaggcctgcagcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgaaaaaaaaaaaaaaaa

SEQ ID NO: 232 - protein, 137 aa, Homo sapiens
MLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 233 - DNA, 1386 bp, Homo sapiens
aggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggaggcccggaggcctgcagcaggagcggccatgaagaagctgatggtggtgctgagtctgattgctgcaggaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgaaaaaaaaaaaaaaaa

SEQ ID NO: 234 - protein, 40 aa, Homo sapiens
MKKLMVVLSLIAAGIFRSSWGSITFGKGRVPRSRVLLSGL

SEQ ID NO: 235 - DNA, 3351 bp, Homo sapiens
gcccgagaagctggggagcatggaccagaccccgcagcgctggcaccatgacgctcgcccgcttcgtgctagccctgatgttaggggcgctccccgaagtggtcggctttgattctgtcctcaatgattccctccaccacagccaccgccattcgccccctgcgggtccgcactacccctattaccttcccacccagcagcggcccccgacgacgcgtccgccgccgcctctcccgcgcttcccgcgccccccgcgggcgctccctgcccagcgcccgcacgccctccaggccgggcacacgccccggccgcacccctggggctgccccgccggcgagccatgggtcagcgtgacggacttcggcgccccgtgtctgcggtgggcggaggtgccacccttcctggagcggtcgcccccagcgagctgggctcagctgcgaggacagcgccacaacttttgtcggagccccgacggcgcgggcagaccctggtgtttctacggagacgcccgtggcaaggtggactggggctactgcgactgcagacacggatcagtacgacttcgtggcggcaaaaatgagtttgaaggcacagtggaagtatatgcaagtggagtttggggcactgtctgtagcagccactgggatgattctgatgcatcagtcatttgtcaccagctgcagctgggaggaaaaggaatagcaaaacaaaccccgttttctggactgggccttattcccatttattggagcaatgtccgttgccgaggagatgaagaaaatatactgctttgtgaaaaagacatctggcagggtggggtgtgtcctcagaagatggcagctgctgtcacgtgtagcttttcccatggcccaacgttccccatcattcgccttgctggaggcagcagtgtgcatgaaggccgggtggagctctaccatgctggccagtggggaaccgtttgtgatgaccaatgggatgatgccgatgcagaagtgatctgcaggcagctgggcctcagtggcattgccaaagcatggcatcaggcatattttggggaagggtctggcccagttatgttggatgaagtacgctgcactgggaatgagctttcaattgagcagtgtccaaagagctcctggggagagcataactgtggccataaagaagatgctggagtgtcctgtacccctctaacagatggggtcatcagacttgcaggtgggaaaggcagccatgagggtcgcttggaggtatattacagaggccagtggggaactgtctgtgatgatggctggactgagctgaatacatacgtggtttgtcgacagttgggatttaaatatggtaaacaagcatctgccaaccattttgaagaaagcacagggcccatatggttggatgacgtcagctgctcaggaaaggaaaccagatttcttcagtgttccaggcgacagtggggaaggcatgactgcagccaccgcgaagatgttagcattgcctgctaccctggcggcgagggacacaggctctctctgggttttcctgtcagactgatggatggagaaaataagaaagaaggacgagtggaggtttttatcaatggccagtggggaacaatctgtgatgatggatggactgataaggatgcagctgtgatctgtcgtcagcttggctacaagggtcctgccagagcaagaaccatggcttactttggagaaggaaaaggacccatccatgtggataatgtgaagtgcacaggaaatgagaggtccttggctgactgtatcaagcaagatattggaagacacaactgccgccacagtgaagatgcaggagttatttgtgattattttggcaagaaggcctcaggtaacagtaataaagagtccctctcatctgtttgtggcttgagattactgcaccgtcggcagaagcggatcattggtgggaaaaattctttaaggggtggttggccttggcaggtttccctccggctgaagtcatcccatggagatggcaggctcctctgcggggctacgctcctgagtagctgctgggtcctcacagcagcacactgtttcaagaggtatggcaacagcactaggagctatgctgttagggttggagattatcatactctggtaccagaggagtttgaggaagaaattggagttcaacagattgtgattcatcgggagtatcgacccgaccgcagtgattatgacatagccctggttagattacaaggaccagaagagcaatgtgccagattcagcagccatgttttgccagcctgtttaccactctggagagagaggccacagaaaacagcatccaactgttacataacaggatggggtgacacaggacgagcctattcaagaacactacaacaagcagccattcccttacttcctaaaaggttttgtgaagaacgttataagggtcggtttacagggagaatgctttgtgctggaaacctccatgaacacaaacgcgtggacagctgccagggagacagcggaggaccactcatgtgtgaacggcccggagagagctgggtggtgtatggggtgacctcctgggggtatggctgtggagtcaaggattctcctggtgtttataccaaagtctcagcctttgtaccttggataaaaagtgtcaccaaactgtaattcttcatggaaacttcaaagcagcatttaaacaaatggaaaactttgaacccccactattagcactcagcagagatgacaacaaatggcaagatctgtttttgctttgtgttgtggtaaaaaattgtgtaccccctgctgcttttgagaaatttgtgaacattttcagaggcctcagtgtagtggaagtgataatccttaaatgaacattttctaccctaatttcactggagtgacttattctaagcctcatctatcccctacctatttctcaaaatcattctatgctgattttacaaaagatcatttttacatttgaactgagaaccccttttaattgaatcagtggtgtctgaaatcatattaaatacccacatttgacataaatgcggtaccctttactacactcatgagtggcatatttatgcttaggtcttttcaaaagacttgacaagaaatcttcatattctctgtagcctttgtcaagtgaggaaatcagtggttaaagaattccactataaacttttaggcctgaataggagtagtaaagcctcaaggacatctgcctgtcacaatatattctcaaagtgatctgatatttggaaacaagtatccttgttgagtaccaagtgctacagaaaccataagataaaaatactttctacctacagcgtgc

SEQ ID NO: 236 - protein, 875 aa, Homo sapiens
MTLARFVLALMLGALPEVVGFDSVLNDSLHHSHRHSPPAGPHYPYYLPTQQRPPTTRPPPPLPRFPRPPRALPAQRPHALQAGHTPRPHPWGCPAGEPWVSVTDFGAPCLRWAEVPPFLERSPPASWAQLRGQRHNFCRSPDGAGRPWCFYGDARGKVDWGYCDCRHGSVRLRGGKNEFEGTVEVYASGVWGTVCSSHWDDSDASVICHQLQLGGKGIAKQTPFSGLGLIPIYWSNVRCRGDEENILLCEKDIWQGGVCPQKMAAAVTCSFSHGPTFPIIRLAGGSSVHEGRVELYHAGQWGTVCDDQWDDADAEVICRQLGLSGIAKAWHQAYFGEGSGPVMLDEVRCTGNELSIEQCPKSSWGEHNCGHKEDAGVSCTPLTDGVIRLAGGKGSHEGRLEVYYRGQWGTVCDDGWTELNTYVVCRQLGFKYGKQASANHFEESTGPIWLDDVSCSGKETRFLQCSRRQWGRHDCSHREDVSIACYPGGEGHRLSLGFPVRLMDGENKKEGRVEVFINGQWGTICDDGWTDKDAAVICRQLGYKGPARARTMAYFGEGKGPIHVDNVKCTGNERSLADCIKQDIGRHNCRHSEDAGVICDYFGKKASGNSNKESLSSVCGLRLLHRRQKRIIGGKNSLRGGWPWQVSLRLKSSHGDGRLLCGATLLSSCWVLTAAHCFKRYGNSTRSYAVRVGDYHTLVPEEFEEEIGVQQIVIHREYRPDRSDYDIALVRLQGPEEQCARFSSHVLPACLPLWRERPQKTASNCYITGWGDTGRAYSRTLQQAAIPLLPKRFCEERYKGRFTGRMLCAGNLHEHKRVDSCQGDSGGPLMCERPGESWVVYGVTSWGYGCGVKDSPGVYTKVSAFVPWIKSVTKL

SEQ ID NO: 237 - DNA, 1165 bp, Homo sapiens
agaaggaacagggagcggccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccgcgaccgatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggagagccagcccctcctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcctcctgagtgctggacctcattaaagtgcatggaaatca

SEQ ID NO: 238 - protein, 275 aa, Homo sapiens
MLNLLLLALPVLASRAYAAPAPGQALQRVGIVGGQEAPRSKWPWQVSLRVRDRYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 239 - DNA, 1013 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 240 - protein, 260 aa, Homo sapiens
MGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 241 - DNA, 1148 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagcgtgtggaagcctggacctcctcactaagttgtatgcggagaacttgccgtgtgtccatttgaacccacagtggccttcccagccctcgcactgccccagagggtggcgatccaaccctctccctcctgctgcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 242 - protein, 305 aa, Homo sapiens
MGRPRPRAAKTWMFLLLLGGAWAACGSLDLLTKLYAENLPCVHLNPQWPSQPSHCPRGWRSNPLPPAAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 243 - DNA, 590 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 244 - protein, 119 aa, Homo sapiens
MGRPRPRAAKTWMFLLLLGGAWAENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 245 - DNA, 456 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 246 - protein, 32 aa, Homo sapiens
MGRPRPRAAKTWMFLLLLGGAWAGRFWRPPGV

SEQ ID NO: 247 - DNA, 1580 bp, Homo sapiens
catcctgccacccctagccttgctggggacgtgaaccctctccccgcgcctgggaagccttcttggcaccgggacccggagaatccccacggaagccagttccaaaagggatgaaaagggggcgtttcgggcactgggagaagcctgtattccagggcccctcccagagcaggaatctgggacccaggagtgccagcctcacccacgcagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtga

SEQ ID NO: 248 - protein, 276 aa, Homo sapiens
MRAPHLHLSAASGARALAKLLPLLMAQLWAAEAALLPQNDTRLDPEAYGSPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPVVLGPRVRALQLPYRCAQPGDQCQVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 249 - DNA, 1443 bp, Homo sapiens
accagcggcagaccacaggcagggcagaggcacgtctgggtcccctccctccttcctatcggcgactcccaggatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtga

SEQ ID NO: 250 - protein, 276 aa, Homo sapiens; identical to SEQ ID NO: 248

SEQ ID NO: 251 - DNA, 3226 bp, Homo sapiens
cgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcacctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagcaaaaaaaaaaaaaaaaaaaaaaaaaaaaaaa

SEQ ID NO: 252 - protein, 492 aa, Homo sapiens
MALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQMYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 253 - DNA, 1280 bp, Homo sapiens
atggccacagcaggaaatccctggggctggttcctggggtacctcatccttggtgtcgcaggatctctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaagcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgc

SEQ ID NO: 254 - protein, 254 aa, Homo sapiens
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQDQKDSCNGDSGGPLICNGYLQGLVSFGKAPCGQVGVPGVYTNLCKFTEWIEKTVQAS

SEQ ID NO: 255 - DNA, 1391 bp, Homo sapiens
acacaccctgacccgcatcgccctgggtctctcgagcctgctgcctgctcccccgccccaccagccatggtggtttctggagcgcccccagccctgggtgggggctgtctcggcaccttcacctccctgctgctgctggcgtcgacagccatcctcaatgcggccaggatacctgttcccccagcctgtgggaagccccagcagctgaaccgggttgtgggcggcgaggacagcactgacagcgagtggccctggatcgtgagcatccagaagaatgggacccaccactgcgcaggttctctgctcaccagccgctgggtgatcactgctgcccactgtttcaaggacaacctgaacaaaccatacctgttctctgtgctgctgggggcctggcagctggggaaccctggctctcggtcccagaaggtgggtgttgcctgggtggagccccaccctgtgtattcctggaaggaaggtgcctgtgcagacattgccctggtgcgtctcgagcgctccatacagttctcagagcgggtcctgcccatctgcctacctgatgcctctatccacctccctccaaacacccactgctggatctcaggctgggggagcatccaagatggagttcccttgccccaccctcagaccctgcagaagctgaaggttcctatcatcgactcggaagtctgcagccatctgtactggcggggagcaggacagggacccatcactgaggacatgctgtgtgccggctacttggagggggagcgggatgcttgtctgggcgactccgggggccccctcatgtgccaggtggacggcgcctggctgctggccggcatcatcagctggggcgagggctgtgccgagcgcaacaggcccggggtctacatcagcctctctgcgcaccgctcctgggtggagaagatcgtgcaaggggtgcagctccgcgggcgcgctcaggggggtggggccctcagggcaccgagccagggctctggggccgccgcgcgctcctagggcgcagcgggacgcggggctcggatctgaaaggcggccagatccacatctggatctggatctgcggcggcctcgggcggtttcccccgccgtaaataggctcatctacctctacctctgggggcccggacggctgctgcggaaaggaaaccccctccccgacccgcccgacggcctcaggccccgcctccaaggcatcaggccccgcccaacggcctcatgtccccgcccccacgacttccggccccgccccgggccccagcgcttttgtgtatataaatgttaatgatttttataggtatttgtaaccctgcccacatatcttatttattcctccaatttcaataaattatttattctccagtgaaaaa

SEQ ID NO: 256 - protein, 317 aa, Homo sapiens
MVVSGAPPALGGGCLGTFTSLLLLASTAILNAARIPVPPACGKPQQLNRVVGGEDSTDSEWPWIVSIQKNGTHHCAGSLLTSRWVITAAHCFKDNLNKPYLFSVLLGAWQLGNPGSRSQKVGVAWVEPHPVYSWKEGACADIALVRLERSIQFSERVLPICLPDASIHLPPNTHCWISGWGSIQDGVPLPHPQTLQKLKVPIIDSEVCSHLYWRGAGQGPITEDMLCAGYLEGERDACLGDSGGPLMCQVDGAWLLAGIISWGEGCAERNRPGVYISLSAHRSWVEKIVQGVQLRGRAQGGGALRAPSQGSGAAARS

SEQ ID NO: 257 - DNA, 1184 bp, Homo sapiens
atctgccacgatgttgctgctcagcctgaccctaagcctggttctcctcggctcctcctggggctgcggcattcctgccatcaaaccggcactgagcttcagccagaggattgtcaacggggagaatgcagtgttgggctcctggccctggcaggtgtccctgcaggacagcagcggcttccacttctgcggtggttctctcatcagccagtcctgggtggtcactgctgcccactgcaatgtcagccctggccgccattttgttgtcctgggcgagtatgaccgatcatcaaacgcagagcccttgcaggttctgtccgtctctcgggccattacacaccctagctggaactctaccaccatgaacaatgacgtgacgctgctgaagctcgcctcgccagcccagtacacaacacgcatctcgccagtttgcctggcatcctcaaacgaggctctgactgaaggcctcacgtgtgtcaccaccggctggggtcgcctcagtggcgtgggcaatgtgacaccagcacatctgcagcaggtggctttgcccctggtcactgtgaatcagtgccggcagtactggggctcaagtatcactgactccatgatctgtgcaggtggcgcaggtgcctcctcgtgccagggtgactccggaggccctcttgtctgccagaagggaaacacatgggtgcttattggtattgtctcctggggcaccaaaaactgcaatgtgcgcgcacctgctgtgtatactcgagttagcaagttcagcacctggatcaaccaggtcatagcctacaactgagctcaccacaggccctccccagctcaacccattaaagacccaggccctgtcccatcatgcattcatgtctgtcttcctggctcaggagaaagaagaggctgttgagggtccgactccctacttggacttctggcacagaaggggctgagtgactccttgagtagcagtggctcttcctagagtagccatgccgaggccggggcccccacccctcctccagggcaaccccttggtcctacagcaagaagccagaactgttggaatgaatggcagccctccctggagaggcagcctgtttactgaatacagaggatacgtttacaaactgaatacgcataataaataactgcacattctccatccaaaaaaaaaaaaaaaa

SEQ ID NO: 258 - protein, 264 aa, Homo sapiens
MLLLSLTLSLVLLGSSWGCGIPAIKPALSFSQRIVNGENAVLGSWPWQVSLQDSSGFHFCGGSLISQSWVVTAAHCNVSPGRHFVVLGEYDRSSNAEPLQVLSVSRAITHPSWNSTTMNNDVTLLKLASPAQYTTRISPVCLASSNEALTEGLTCVTTGWGRLSGVGNVTPAHLQQVALPLVTVNQCRQYWGSSITDSMICAGGAGASSCQGDSGGPLVCQKGNTWVLIGIVSWGTKNCNVRAPAVYTRVSKFSTWINQVIAYN

SEQ ID NO: 259 - DNA, 1207 bp, Homo sapiens
ggagtgcaggcttggaaagcaggagagctcagcctacgtctttaatcctcctgcccaccccttggattctgtctccactgggactcaagagaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaaaaaaaaaaaaaaaa

SEQ ID NO: 260 - protein, 250 aa, Homo sapiens
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 261 - DNA, 1289 bp, Homo sapiens
ctgccttgctccacacctggtcaggggagagaggggaggaaagccaagggaagggacctaactgaaaacaaacaagctgggagaagcaggaatctgcgctcgggttccgcagatgcagaggttgaggtggctgcgggactggaagtcatcgggcagaggtctcacagcagccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaaaaaaaaaaaaaaaa

SEQ ID NO: 262 - protein, 282 aa, Homo sapiens
MQRLRWLRDWKSSGRGLTAAKEPGARSSPLQAMRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 263 - DNA, 802 bp, Homo sapiens
accaccatgaatctacttctgatccttacctttgttgcagctgctgttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcac

SEQ ID NO: 264 - protein, 247 aa, Homo sapiens
MNLLLILTFVAAAVAAPFDDDDKIVGGYICEENSVPYQVSLNSGYHFCGGSLISEQWVVSAGHCYKSRIQVRLGEHNIEVLEGNEQFINAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 265 - DNA, 1475 bp, Homo sapiens
acctgccgccatcttgctcaccagcctccaaaatgcggctggggctcctgagcgtggcgctgttgtttgtggggagctctcacttatactcagaccactactcgccctctggaaggcacaggctcggcccctcgccggaaccggcggctagttcccagcaggctgaggccgtccgcaagaggctccggcggcggagggagggaggggcgcatgcaaaggattgtggaacagcaccgcttaaggatgtgttgcaagggtctcggattatagggggcaccgaagcacaagctggcgcatggccgtgggtggtgagcctgcagattaaatatggccgtgttcttgttcatgtatgtgggggaaccctagtgagagagaggtgggtcctcacagctgcccactgcactaaagacgctagcgatcctttaatgtggacagctgtgattggaactaataatatacatggacgctatcctcataccaagaagataaaaattaaagcaatcattattcatccaaacttcattttggaatcttatgtaaatgatattgcactttttcacttaaaaaaagcagtgaggtataatgactatattcagcctatttgcctaccttttgatgttttccaaatcctggacggaaacacaaagtgttttataagtggctggggaagaacaaaagaagaaggtaacgctacaaatattttacaagatgcagaagtgcattatatttctcgagagatgtgtaattctgagaggagttatgggggaataattcctaacacttcattttgtgcaggtgatgaagatggagcttttgatacttgcaggggtgacagtgggggaccattaatgtgctacttaccagaatataaaagattttttgtaatgggaattaccagttacggacatggctgtggtcgaagaggttttcctggtgtctatattgggccatccttctaccaaaagtggctgacagagcatttcttccatgcaagcactcaaggcatacttactataaatattttacgtggccagatcctcatagctttatgttttgtcatcttactagcaacaacataaagaaattctgaaggctttcatatctttattttgcattgtgtccctttctatgttctatataatgaacatcatttattcttctagcaattaattgcctacattagagatttcatgtgaacattttatgggctataagtattgtgacagatatacaattgtaattttggcactgaatcacatgtctccttgaaatatcttgattattttataatcataattctgtatctggaatactcatagagtttgtacaaaatattcagttaaacatatatgtgtataaatgccaaataatagtttataattaaaatgaaagctgtcatttggttaaattaataaaaattctttcttagattttattctaaaaaaaaaaaaaaaaaaagaaaaaaaaaaaaaaaa

SEQ ID NO: 266 - protein, 348 aa, Homo sapiens
MRLGLLSVALLFVGSSHLYSDHYSPSGRHRLGPSPEPAASSQQAEAVRKRLRRRREGGAHAKDCGTAPLKDVLQGSRIIGGTEAQAGAWPWVVSLQIKYGRVLVHVCGGTLVRERWVLTAAHCTKDASDPLMWTAVIGTNNIHGRYPHTKKIKIKAIIIHPNFILESYVNDIALFHLKKAVRYNDYIQPICLPFDVFQILDGNTKCFISGWGRTKEEGNATNILQDAEVHYISREMCNSERSYGGIIPNTSFCAGDEDGAFDTCRGDSGGPLMCYLPEYKRFFVMGITSYGHGCGRRGFPGVYIGPSFYQKWLTEHFFHASTQGILTINILRGQILIALCFVILLATT

SEQ ID NO: 267 - DNA, 1164 bp, Homo sapiens
atgattgccgttctcattgtgttgtccctgacagtggtggcagtgaccataggtctcctggttcacttcctagtatttgaccaaaaaaaggagtactatcatggctcctttaaaattttagatccacaaatcaataacaatttcggacaaagcaacacatatcaacttaaggacttacgagagacgaccgaaaatttggtggatgagatatttatagattcagcctggaagaaaaattatatcaagaaccaagtagtcagactgactccagaggaagatggtgtgaaagtagatgtcattatggtgttccagttcccctctactgaacaaagggcagtaagagagaagaaaatccaaagcatcttaaatcagaagataaggaatttaagagccttgccaataaatgcctcatcagttcaagttaatggttgtggtaaacgagttgttccattaaacgtcaacagaatagcatctggagtcattgcacccaaggcggcctggccttggcaagcttcccttcagtatgataacatccatcagtgtggggccaccttgattagtaacacatggcttgtcactgcagcacactgcttccagaagtataaaaatccacatcaatggactgttagttttggaacaaaaatcaaccctcccttaatgaaaagaaatgtcagaagatttattatccatgagaagtaccgctctgcagcaagagagtacgacattgctgttgtgcaggtctcttccagagtcaccttttcggatgacatacgccagatttgtttgccagaagcctctgcatccttccaaccaaatttgactgtccacatcacaggatttggagcactttactatggtggggaatcccaaaatgatctccgagaagccagagtgaaaatcataagtgatgatgtctgcaagcaaccacaggtgtatggcaatgatataaaacctggaatgttctgtgccggatatatggaaggaatttatgatgcctgcaggggtgattctgggggacctttagtcacaagggatctgaaagatacgtggtatctcattggaattgtaagctggggagataactgtggtcaaaaggacaagcctggagtctacacacaagtgacttattaccgaaactggattgcttcaaaaacaggcatctaa

SEQ ID NO: 268 - protein, 387 aa, Homo sapiens
MIAVLIVLSLTVVAVTIGLLVHFLVFDQKKEYYHGSFKILDPQINNNFGQSNTYQLKDLRETTENLVDEIFIDSAWKKNYIKNQVVRLTPEEDGVKVDVIMVFQFPSTEQRAVREKKIQSILNQKIRNLRALPINASSVQVNGCGKRVVPLNVNRIASGVIAPKAAWPWQASLQYDNIHQCGATLISNTWLVTAAHCFQKYKNPHQWTVSFGTKINPPLMKRNVRRFIIHEKYRSAAREYDIAVVQVSSRVTFSDDIRQICLPEASASFQPNLTVHITGFGALYYGGESQNDLREARVKIISDDVCKQPQVYGNDIKPGMFCAGYMEGIYDACRGDSGGPLVTRDLKDTWYLIGIVSWGDNCGQKDKPGVYTQVTYYRNWIASKTGI

SEQ ID NO: 269 - protein, 431 aa, Rattus norvegicus
MARGQPRRSEEPWTALRNRTECKTKIKLTKCGKITLGILTAVIAAVVIGLIAYFAACGKTPFYYHVSFKVNNIDYDSKFAKPYSQEYMDLNKRIVSLMNETFHESKLRKQYVKAHTVQVSKAKGKVVIHGVLKFKSCYKNNVEKFWDSVETILYQKLKSQTRLLIDSSSFKFSDIAMPIAEDLLNTCCGRRTITPGGHKVAGGQDAEEGEWPWQASLQQNNVHRCGATLISNSWLITAAHCFVRSANPKDWKVSFGFLLSKPQAQRAVKSIVIHENYSYPAHNNDIAVVRLSSPVLYENNIRRACLPEATQKFPPNSDVVVTGWGTLKSDGDSPNILQKGRVKIIDNKTCNSGKAYGGVITPGMLCAGFLEGRVDACQGDSGGPLVSEDSKGIWFLAGIVSWGDECALPNKPGVYTRVTHYRDWISSKTGL

SEQ ID NO: 270 - protein, 247 aa, Homo sapiens
MNPLLILAFVGAAVAVPFDDDDKIVGGYTCEENSVPYQVSLNSGSHFCGGSLISEQWVVSAGHCYKPHIQVRLGEHNIEVLEGNEQFINAAKIIRHPKYNRITLNNDIMLIKLSTPAVINAHVSTISLPTAPPAAGTECLISGWGNTLSSGADYPDELQCLDAPVLTQAKCKASYPLKITSKMFCVGFLEGGKDSCQGDSGGPVVCNGQLQGIVSWGYGCAQKRRPGVYTKVYNYVDWIKDTIAANS

SEQ ID NO: 271 - DNA, 1099 bp, Homo sapiens
gcacagcccagggccatgctcctgttctcagtgttgctgctcctgtccctggtcacgggaactcagctcggtccacggactcctctcccagaggctggagtggctatcctaggcagggctaggggagcccaccgccctcagccccgtcatccccccagcccagtcagtgaatgtggtgacagatctattttcgagggaagaactcggtattccagaatcacaggggggatggaggcggaggtgggtgagtttccgtggcaggtgagtattcaggcaagaagtgaacctttctgtggcggctccatcctcaacaagtggtggattctcactgcggctcactgcttatattccgaggagctgtttccagaagaactgagtgtcgtgctggggaccaacgacttaactagcccatccatggaaataaaggaggtcgccagcatcattcttcacaaagactttaagagagccaacatggacaatgacattgccttgctgctgctggcttcgcccatcaagctcgatgacctgaaggtgcccatctgcctccccacgcagcccggccctgccacatggcgcgaatgctgggtggcaggttggggccagaccaatgctgctgacaaaaactctgtgaaaacggatctgatgaaagtgccaatggtcatcatggactgggaggagtgttcaaagatgtttccaaaacttaccaaaaatatgctgtgtgccggatacaagaatgagagctatgatgcctgcaagggtgacagtggggggcctctggtctgcaccccagagcctggtgagaagtggtaccaggtgggcatcatcagctggggaaagagctgtggagagaagaacaccccagggatatacacctcgttggtgaactacaacctctggatcgagaaagtgacccagctagagggcaggcccttcaatgcagagaaaaggaggacttctgtcaaacagaaacctatgggctccccagtctcgggagtcccagagccaggcagccccagatcctggctcctgctctgtcccctgtcccatgtgttgttcagagctattttgtactgataataaaatagaggctattctttca

SEQ ID NO: 272 - protein, 352 aa, Homo sapiens
MLLFSVLLLLSLVTGTQLGPRTPLPEAGVAILGRARGAHRPQPRHPPSPVSECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAADKNSVKTDLMKVPMVIMDWEECSKMFPKLTKNMLCAGYKNESYDACKGDSGGPLVCTPEPGEKWYQVGIISWGKSCGEKNTPGIYTSLVNYNLWIEKVTQLEGRPFNAEKRRTSVKQKPMGSPVSGVPEPGSPRSWLLLCPLSHVLFRAILY

SEQ ID NO: 273 - DNA, 1927 bp, Homo sapiens
tgccagcccaagtcggaacttggatcacatcagatcctctcgagctccagcaggagaggcccttcctcgcctggcagcccctgagcggctcagcagggcaccatggcaagatcccttctcctgcccctgcagatcttactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaaccaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaacgtacaccgagacccttattcaccacctttgacccagtaactctaatcttaggaagaacctactgaaacaaaaaaaatccaaaatgtagaacaagacttgaatttaccatgatattatttatcacagaaatgaagtgaaaccatcaaacatgttccaaaagtaccagatggcttaaataatagtctggcttggcacaacgatgttttttttctttgagacagagtctctgttgcttgggctgcaatgcagtgatgcaatcttggctcactgcaacctccgcctcctgggttcaagtgattctcgtgcttcagcctcccaagtacctgggactacaggtgtgcaccaccacaccaggctaattttttgtgtatttttactagagacagggtttcaccatgttggccagcgtggtcttgaacgcctgacctcagatgatccacccaccttggcctcccaaagtgctgggattacaggcatgagccaccacggccagcccacaatgatattacaaacctattaaaaatgatacttagacagaattgtcagtattattcaagaacatttaggctataggatgttaaatgacaaaaggaaggacaaaaatatatatgtatgtgaccctacccataaaaaatgaaatattcacagaatcagatctgaaaacacatgtcccagactgcatactggggtcgtcatgaggtgtctccttccttctgtgtacttttccttgaatgtgcacttttataacatgaaaaataaaggtggggaaaaaagtctgaaga

SEQ ID NO: 274 - protein, 253 aa, Homo sapiens
MARSLLLPLQILLLSLALETAGEEAQGDKIIDGAPCARGSHPWQVALLSGNQLHCGGVLVNERWVLTAAHCKMNEYTVHLGSDTLGDRRAQRIKASKSFRHPGYSTQTHVNDLMLVKLNSQARLSSMVKKVRLPSRCEPPGTTCTVSGWGTTTSPDVTFPSDLMCVDVKLISPQDCTKVYKDLLENSMLCAGIPDSKKNACNGDSGGPLVCRGTLQGLVSWGTFPCGQPNDPGVYTQVCKFTKWINDTMKKHR

SEQ ID NO: 275 - DNA, 1927 bp, Homo sapiens
ggagagggtgatgctggctccaagcctgactctgctctcgagagctccagcaggagaggcccttcctcgcctggcagcccctgagcggctcagcagggcaccatggcaagatcccttctcctgcccctgcagatcttactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaaccaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaacgtacaccgagacccttattcaccacctttgacccagtaactctaatcttaggaagaacctactgaaacaaaaaaaatccaaaatgtagaacaagacttgaatttaccatgatattatttatcacagaaatgaagtgaaaccatcaaacatgttccaaaagtaccagatggcttaaataatagtctggcttggcacaacgatgttttttttctttgagacagagtctctgttgcttgggctgcaatgcagtgatgcaatcttggctcactgcaacctccgcctcctgggttcaagtgattctcgtgcttcagcctcccaagtacctgggactacaggtgtgcaccaccacaccaggctaattttttgtgtatttttactagagacagggtttcaccatgttggccagcgtggtcttgaacgcctgacctcagatgatccacccaccttggcctcccaaagtgctgggattacaggcatgagccaccacggccagcccacaatgatattacaaacctattaaaaatgatacttagacagaattgtcagtattattcaagaacatttaggctataggatgttaaatgacaaaaggaaggacaaaaatatatatgtatgtgaccctacccataaaaaatgaaatattcacagaatcagatctgaaaacacatgtcccagactgcatactggggtcgtcatgaggtgtctccttccttctgtgtacttttccttgaatgtgcacttttataacatgaaaaataaaggtggggaaaaaagtctgaaga

SEQ ID NO: 276 - protein, 253 aa, Homo sapiens; identical to SEQ ID NO: 274

SEQ ID NO: 277 - DNA, 2800 bp, Homo sapiens
atttgagtgggaatctcaaagcagttgagtaggcagaaaaaagaacctcttcattaaggattaaaatgtataggccagcacgtgtaacttcgacttcaagatttctgaatccatatgtagtatgtttcattgtcgtcgcaggggtagtgatcctggcagtcaccatagctctacttgtttactttttagcttttgatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatcacttactgaccaggctgcagcaaattggcttattaatgaatgtggggccggtccagacctaataacattgtctgagcagagaatccttggaggcactgaggctgaggagggaagctggccgtggcaagtcagtctgcggctcaataatgcccaccactgtggaggcagcctgatcaataacatgtggatcctgacagcagctcactgcttcagaagcaactctaatcctcgtgactggattgccacgtctggtatttccacaacatttcctaaactaagaatgagagtaagaaatattttaattcataacaattataaatctgcaactcatgaaaatgacattgcacttgtgagacttgagaacagtgtcacctttaccaaagatatccatagtgtgtgtctcccagctgctacccagaatattccacctggctctactgcttatgtaacaggatggggcgctcaagaatatgctggccacacagttccagagctaaggcaaggacaggtcagaataataagtaatgatgtatgtaatgcaccacatagttataatggagccatcttgtctggaatgctgtgtgctggagtacctcaaggtggagtggacgcatgtcagggtgactctggtggcccactagtacaagaagactcacggcggctttggtttattgtggggatagtaagctggggagatcagtgtggcctgccggataagccaggagtgtatactcgagtgacagcctaccttgactggattaggcaacaaactgggatctagtgcaacaagtgcatccctgttgcaaagtctgtatgcaggtgtgcctgtcttaaattccaaagctttacatttcaactgaaaaagaaactagaaatgtcctaatttaacatcttgttacataaatatggtttaacaaacactgtttaacctttctttattattaaaggttttctattttctccagagaactatatgaatgttgcatagtactgtggctgtgtaacagaagaaacacactaaactaattacaaagttaacaatttcattacagttgtgctaaatgcccgtagtgagaagaacaggaaccttgagcatgtatagtagaggaacctgcacaggtctgatgggtcagaggggtcttctctgggtttcactgaggatgagaagtaagcaaactgtggaaacatgcaaaggaaaaagtgatagaataatattcaagacaaaaagaacagtatgaggcaagagaaataatatgtatttaaaatttttggttactcaatatcttatacttagtatgagtcctaaaattaaaaatgtgaaactgttgtactatacgtataacctaaccttaattattctgtaagaacatgcttccataggaaatagtggataattttcagctatttaaggcaaaagctaaaatagttcactcctcaactgagacccaaagaattatagatatttttcatgatgacccatgaaaaatatcactcatctacataaaggagagactatatctattttatagagaagctaagaaatatacctacacaaacttgtcaggtgctttacaactacatagtactttttaacaacaaaataataattttaagaatgaaaaatttaatcatcgggaagaacgtcccactacagacttcctatcactggcagttatatttttgagcgtaaaagggtcgtcaaacgctaaatctaagtaacgaattgaaagtttaaagagggggaagagttggtttgcaaaggaaaagtttaaatagcttaatatcaatagaatgatcctgaagacagaaaaaactttgtcactcttcctctctcattttctttctctctctctccccttctcatacacatgcctcccccaccaaagaatataatgtaaattaaatccactaaaatgtaatggcatgaaaatctctgtagtctgaatcactaatattcctgagtttttatgagctcctagtacagctaaagtttgcctatgcatgatcatctatgcgtcagagcttcctccttctacaagctaactccctgcatctgggcatcaggactgctccatacatttgctgaaaacttcttgtatttcctgatgtaaaattgtgcaaacacctacaataaagccatctacttttagggaaagggagttgaaaatgcaaccaactcttggcgaactgtacaaacaaatctttgctatactttatttcaaataaattctttttaaaataaaaaaaaaaaaaaaaaaa

SEQ ID NO: 278 - protein, 418 aa, Homo sapiens
MYRPARVTSTSRFLNPYVVCFIVVAGVVILAVTIALLVYFLAFDQKSYFYRSSFQLLNVEYNSQLNSPATQEYRTLSGRIESLITKTFKESNLRNQFIRAHVAKLRQDGSGVRADVVMKFQFTRNNNGASMKSRIESVLRQMLNNSGNLEINPSTEITSLTDQAAANWLINECGAGPDLITLSEQRILGGTEAEEGSWPWQVSLRLNNAHHCGGSLINNMWILTAAHCFRSNSNPRDWIATSGISTTFPKLRMRVRNILIHNNYKSATHENDIALVRLENSVTFTKDIHSVCLPAATQNIPPGSTAYVTGWGAQEYAGHTVPELRQGQVRIISNDVCNAPHSYNGAILSGMLCAGVPQGGVDACQGDSGGPLVQEDSRRLWFIVGIVSWGDQCGLPDKPGVYTRVTAYLDWIRQQTGI

SEQ ID NO: 279 - DNA, 1258 bp, Homo sapiens
tcaggccccgcccgccctgccctcccctcccgatcccggagccatgtggcccctggccctagtgatcgcctccctgaccttggccttgtcaggaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccaggtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgaca

SEQ ID NO: 280 - protein, 277 aa, Homo sapiens
MWPLALVIASLTLALSGGVSQESSKVLNTNGTSGFLPGGYTCFPHSQPWQAALLVQGRLLCGGVLVHPKWVLTAAHCLKEGLKVYLGKHALGRVEAGEQVREVVHSIPHPEYRRSPTHLNHDHDIMLLELQSPVQLTGYIQTLPLSHNNRLTPGTTCRVSGWGTTTSPQVNYPKTLQCANIQLRSDEECRQVYPGKITDNMLCAGTKEGGKDSCEGDSGGPLVCNRTLYGIVSWGDFPCGQPDRPGVYTRVSRYVLWIRETIRKYETQQQKWLKGPQ

SEQ ID NO: 281 - DNA, 1438 bp, Homo sapiens
catggaggaggaaggagatggcatggcttaccataaagaagcactggacgccgggtgcacgttccaggatccaggtgcccaggggtcatgaagctgggactcctctgtgctctgctctctctgctggcagggcatggctgggcagacacccgtgccatcggggccgaggaatgtcgccccaactcccagccttggcaggccggcctcttccaccttactcggctcttctgtggggcgaccctcatcagtgaccgctggctgctcacagctgcccactgccgcaagccgtatctgtgggtccgccttggagagcaccacctctggaaatgggagggtccggagcagctgttccgggttacggacttcttcccccaccctggcttcaacaaggacctcagcgccaatgaccacaatgatgacatcatgctgatccgcctgcccaggcaggcacgtctgagtcctgctgtgcagcccctcaacctcagccagacctgtgtctccccaggcatgcagtgtctcatctcaggctggggggccgtgtccagccccaaggcgctgtttccagtcacactgcagtgtgccaacatcagcatcctggagaacaaactctgtcactgggcataccctggacacatctcggacagcatgctctgtgcgggcctgtgggaggggggccgaggttcctgccagggtgactctgggggccccctggtttgcaatggaaccttggcaggcgtggtgtctgggggtgctgagccctgctccagaccccggcgccccgcagtctacaccagcgtatgccactaccttgactggatccaagaaatcatggagaactgagcccgcgcgccacgggggcaccttggaagaccaagagaggccgaagggcacggggtagggggttctcgtagggtcccagcctcaatggttcccgccctggacctccagctgccctgactcccctctggacactaagactccgcccctgaggctccgccccctcacgaggtcaagcaagacacagtcgcgccccctcggaacggagcagggacacgcccttcagagcccgtctctatgacgtcaccgacagccatcacctccttcttggaacagcacagcctgtggctccgccccaaggaaccacttacacaaaatagctccgcccctcggaactttgcccagtgggacttcccctcgggactccaccccttgtggccccgcctccttcaccagagatctcgcccctcgtgatgtcaggggcgcagtagctccgcccacgtggagctcgggcggtgtagagctcagccccttgtggccccgtcctgggcgtgtgctgggtttgaatcctggcggagacctggggggaaattgagggagggtctggatacctttagagccaatgcaacggatgatttttcagtaaacgcgggaaacctca

SEQ ID NO: 282 - protein, 250 aa, Homo sapiens
MKLGLLCALLSLLAGHGWADTRAIGAEECRPNSQPWQAGLFHLTRLFCGATLISDRWLLTAAHCRKPYLWVRLGEHHLWKWEGPEQLFRVTDFFPHPGFNKDLSANDHNDDIMLIRLPRQARLSPAVQPLNLSQTCVSPGMQCLISGWGAVSSPKALFPVTLQCANISILENKLCHWAYPGHISDSMLCAGLWEGGRGSCQGDSGGPLVCNGTLAGVVSGGAEPCSRPRRPAVYTSVCHYLDWIQEIMEN

SEQ ID NO: 283 - DNA, 3212 bp, Homo sapiens
cttgagccagacccagtccagctctggtgcctgccctctggtgcgagctgacctgagatgcacttccctcctctgtgagctgtctcggcacccacttgcagtcactgccgcctgatgttgttactcttccactccaaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggctgtgtggcttgcgcatcctgcagccctacgccgagaggatccccgtggtggccacggccgggatcaccatcaacttcacctcccagatctccctcaccgggcccggtgtgcgggtgcactatggcttgtacaaccagtcggacccctgccctggagagttcctctgttctgtgaatggactctgtgtccctgcctgtgatggggtcaaggactgccccaacggcctggatgagagaaactgcgtttgcagagccacattccagtgcaaagaggacagcacatgcatctcactgcccaaggtctgtgatgggcagcctgattgtctcaacggcagcgacgaagagcagtgccaggaaggggtgccatgtgggacattcaccttccagtgtgaggaccggagctgcgtgaagaagcccaacccgcagtgtgatgggcggcccgactgcagggacggctcggatgaggagcactgtgactgtggcctccagggcccctccagccgcattgttggtggagctgtgtcctccgagggtgagtggccatggcaggccagcctccaggttcggggtcgacacatctgtgggggggccctcatcgctgaccgctgggtgataacagctgcccactgcttccaggaggacagcatggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcggccccatcagcaacgctctgcagaaagtggatgtgcagttgatcccacaggacctgtgcagcgaggtctatcgctaccaggtgacgccacgcatgctgtgtgccggctaccgcaagggcaagaaggatgcctgtcagggtgactcaggtggtccgctggtgtgcaaggcactcagtggccgctggttcctggcggggctggtcagctggggcctgggctgtggccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtattctggcggggggtgggggagagagcaggccctgtggtggcaggaggtggcatcttgtctcgtccctgatgtctgctccagtgatggcaggaggatggagaagtgccagcagctgggggtcaagacgtcccctgaggacccaggcccacacccagcccttctgcctcccaattctctctcctccgtccccttcctccactgctgcctaatgcaaggcagtggctcagcagcaagaatgctggttctacatcccgaggagtgtctgaggtgcgccccactctgtacagaggctgtttgggcagccttgcctccagagagcagattccagcttcggaagcccctggtctaacttgggatctgggaatggaaggtgctcccatcggaggggaccctcagagccctggagactgccaggtgggcctgctgccactgtaagccaaaaggtggggaagtcctgactccagggtccttgccccacccctgcctgccacctgggccctcacagcccagaccctcactgggaggtgagctcagctgccctttggaataaagctgcctgatcaaaaaaaaaaaaaaaaaaaaa

SEQ ID NO: 284 - protein, 811 aa, Homo sapiens
MLLLFHSKRMPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVT

SEQ ID NO: 285 - DNA, 3750 bp, Homo sapiens
gcgctgctcgccagcttgctcgcactcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaattcttatatgtgtgcatgtgtgttttcttctgagattcatcttggtggtgggtttttttgtttttttaattcagtgcctgatctttaatgcttccataaggcagtgttcccatttaggaactttgacagcatttgttaggcagaatattttggatttggaggcatttgcatggtagtctttgaacagtaaaatgatgtgttgactatactgatacacatattaaactataccttatagtaaaccagtatcccaagctgcttttagttccaaaaatagtttcttttccaaaggttgttgctctactttgtaggaagtctttgcatatggccctcccaactttaaagtcataccagagtggccaagagtgtttatcccaacccttccatttaacaggatttcactcacatttctggaactagctatttttcagaagacaataatcagggcttaattagaacaggctgtatttcctcccagcaaacagttgtggccacactaaaaacaatcatagcattttacccctggattatagcacatctcatgttttatcatttggatggagtaatttaaaatgaattaaattccagagaacaatggaagcattgcctggcagatgtcacaacagaataaccacttgtttggagcctggcacagtcctccagcctgatcaaaaattattctgcatagttttcagtgtgctttctgggagctatgtacttcttcaatttggaaacttttctctctcatttatagtgaaaatacttggaagttactttaagaaaaccagtgtggcctttttccctctagctttaaaagggccgcttttgctggaatgctctaggttatagataaacaattaggtataatagcaaaaatgaaaattggaagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaagcacgtgtttgctgtgcttgcaccccaggtaaacctgcattgtagcaatttgtaaggatattcagatggagcactgtcacttagacattctctgggggattttctgcttgtctttcttgagctttttggaaggataattctgataaggcactcaagaaacgtacaaccacagtgctttcttcaaatcatatgagaaatactatgcatagcaaggagatgcagagccgccaggaaaattctgagttccagcacaattttctttggaatctaacaggaatctagcctgaggaagaagggaggtctccatttctatgtctggtatttgggggttttgtttgtttttgctttagcttggtgaaaaaaagttcactgaacaccaagaccagaatggatttttttaaaaaaatagatgttccttttgtgaagcaccttgattccttgattttgattttttgcaaagttagacaatggcacaaagtcaaaatgaaatcaatgtttagttcacaagtagatgtaatttactaaagaatgatacacccatatgctatatacagcttaactcacagaactgtaaaagaaaattataaaataattcaacatgtccatctttttagtgataataaaagaaagcatggtattaaactatcatagaagtagacagaaaaagaaaaaaggactcatggcattattaatataattagtgctttacatgtgttagttatacatattagaagcatatttgcctagtaaggctagtagaaccacatttcccaaagtgtgctccttaaacactcatgccttatgattttctaccaaaagtaaaaagggttgtattaagtcagaggaagatgcctctccattttccctctctttatcagaggttcacatgcctgtctgcacattaaaagctctgggaagacctgttgtaaagggacaagttgaggttgtaaaatctgcatttaaataaacatctttgatcacaaaaaaaaaaaaaaaaaaaa

SEQ ID NO: 286 - protein, 383 aa, Homo sapiens
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSVKLSTGCTGTLVAEKHVLTAAHCIHDGKTYVKGTQKLRVGFLKPKFKDGGRGANDSTSAMPEQMKFQWIRVKRTHVPKGWIKGNANDIGMDYDYALLELKKPHKRKFMKIGVSPPAKQLPGGRIHFSGYDNDRPGNLVYRFCDVKDETYDLLYQQCDAQPGASGSGVYVRMWKRQQQKWERKIIGIFSGHQWVDMNGSPQDFNVAVRITPLKYAQICYWIKGNYLDCREG

SEQ ID NO: 287 - protein, 26 aa, Homo sapiens
IIGGTESKPDSRPYMALLQIVEPAVH

SEQ ID NO: 288 - DNA, 2265 bp, Homo sapiens
acgcgggatacagggaggggccatgtgcgaaccagggagacctcatcttccaaccaagcttgctgggcttgcatttaatcaatgcatggccagagaacaggagcggaacattgcctagtagaccctgaggctttacaacagtgctactgacccctatgagcctgatgctggatgaccaaccccctatggaggcccagtatgcagaggagggcccaggacctgggatcttcagagcagagcctggagaccagcagcatcccatttctcaggcggtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcactccccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtgcgtgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagagactgctagaagcagcaggaagcctgcccttctgccctctcccctccctgcccctgtgtgagtcttttagggagggtgactgggaggtgccccccgtcccacctttttcctgtgctctaggtgggctaagtgcctccctagaggactccatggctgagaggctcctgggcagatggggtcaaggctgggccagtcccagatgaagcctatgggagtcaggaccctctccactctccctctccactccccttcctgttctcacctggctgtggctggccctgtgtggggtgggtacactggaaaacaagaaggttggagttggtctaggacattggttttaaatgacagttctgtgaactggtccaaggaggttctgttattaaagtgatatatggtcttgaaaaaaaaaaaaaaaaaaaaaaa

SEQ ID NO: 289 - protein, 457 aa, Homo sapiens
MSLMLDDQPPMEAQYAEEGPGPGIFRAEPGDQQHPISQAVCWRSMRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRACAEPNHPGVYAKVAEFLDWIHDTAQDSLL

SEQ ID NO: 290 - DNA, 1243 bp, Homo sapiens
atggctgcccctgcttccgtcatgggcccactcgggccctctgccctgggccttctgctgctgctcctggtggtggcccctccccgggtcgcagcattggtccacagacagccagagaaccagggaatctccctaactggcagcgtggcctgtggtcggcccagcatggaggggaaaatcctgggcggcgtccctgcgcccgagaggaagtggccgtggcaggtcagcgtgcactacgcaggcctccacgtctgcggcggctccatcctcaatgagtactgggtgctgtcagctgcgcactgctttcacagggacaagaatatcaaaatctatgacatgtacgtaggcctcgtaaacctcagggtggccggcaaccacacccagtggtatgaggtgaacagggtgatcctgcaccccacatatgagatgtaccaccccatcggaggtgacgtggccctggtgcagctgaagacccgcattgtgttttctgagtccgtgctcccggtttgccttgcaactccagaagtgaaccttaccagtgccaattgctgggctacgggatggggactagtctcaaaacaaggtgagacctcagacgagctgcaggagatgcagctcccgctgatcctggagccctggtgccacctgctctacggacacatgtcctacatcatgcccgacatgctgtgtgctggggacatcctgaatgctaagaccgtgtgtgagggcgactccgggggcccacttgtctgtgaattcaaccgcagctggttgcagattggaattgtgagctggggccgaggctgctccaaccctctgtaccctggagtgtatgccagtgtttcctatttctcaaaatggatatgtgataacatagaaatcacgcccactcctgctcagccagcccctgctctctctccagctctggggcccactctcagcgtcctaatggccatgctggctggctggtcagtgctgtgaggtcaggatacccactctaggattctcatggctgcacaccctgccccagcccagctgcctccagacccctaagcatctcctgtcctggcctctctgaagcagacaagggccacctatcccgggggtggatgctgagtccaggaggtgatgagcaagtgtacaaaagaaaaaagggaagggggagaggggctggtcagggagaacccagcttgggcagagtgcacctgagatttgataagatcattaaatatttacaaagcaa

SEQ ID NO: 291 - protein, 326 aa, Homo sapiens
MAAPASVMGPLGPSALGLLLLLLVVAPPRVAALVHRQPENQGISLTGSVACGRPSMEGKILGGVPAPERKWPWQVSVHYAGLHVCGGSILNEYWVLSAAHCFHRDKNIKIYDMYVGLVNLRVAGNHTQWYEVNRVILHPTYEMYHPIGGDVALVQLKTRIVFSESVLPVCLATPEVNLTSANCWATGWGLVSKQGETSDELQEMQLPLILEPWCHLLYGHMSYIMPDMLCAGDILNAKTVCEGDSGGPLVCEFNRSWLQIGIVSWGRGCSNPLYPGVYASVSYFSKWICDNIEITPTPAQPAPALSPALGPTLSVLMAMLAGWSVL

SEQ ID NO: 292 - DNA, 1695 bp, Homo sapiens
atgcttataagcaggaacaagctgattttactactaggaatagtcttttttgaacgaggtaaatctgcaactctttcgctccccaaagctcccagttgtgggcagagtctggttaaggtacagccttggaattattttaacattttcagtcgcattcttggaggaagccaagtggagaagggttcctatccctggcaggtatctctgaaacaaaggcagaagcatatttgtggaggaagcatcgtctcaccacagtgggtgatcacggcggctcactgcattgcaaacagaaacattgtgtctactttgaatgttactgctggagagtatgacttaagccagacagacccaggagagcaaactctcactattgaaactgtcatcatacatccacatttctccaccaagaaaccaatggactatgatattgcccttttgaagatggctggagccttccaatttggccactttgtggggcccatatgtcttccagagctgcgggagcaatttgaggctggttttatttgtacaactgcaggctggggccgcttaactgaaggtggcgtcctctcacaagtcttgcaggaagtgaatctgcctattttgacctgggaagagtgtgtggcagctctgttaacactaaagaggcccatcagtgggaagacctttctttgcacaggttttcctgatggagggagagacgcatgtcagggagattcaggaggttcactcatgtgccggaataagaaaggggcctggactctggctggtgtgacttcctggggtttgggctgtggtcgaggctggagaaacaatgtgaggaaaagtgatcaaggatcccctgggatcttcacagacattagtaaagtgcttccctggatccacgaacacatccaaactggtaatcggagaaagagctccagagcctggtgcagtgagcaggatgtcatagtcagcggggctgaggggaagctgcacttcccagaaagcctccacctatattatgagagcaagcaacggtgtgtctggaccctgctggtaccagaggaaatgcatgtgttgctcagtttttcccacctagatgttgagtcttgtcaccacagttacctgtcaatgtattctttagaagacagacccattggaaaattttgtggagaaagcctcccttcatccattcttattggctctaattctctaaggctgaaattcgtctctgatgccacagattatgcagctgggtttaatcttacctataaagctcttaaaccaaactacattcctgattcaggttgcagttacttaactgtcctttttgaagaaggtctcatacagagtctaaactatcctgaaaactacagtgacaaggctaactgtgactggatttttcaagcctccaaacatcacctaattaagctttcatttcagagtctggaaatagaagaaagtggagactgcacttccgactatgtgacagtgcacagcgatgtagaaaggaagaaggaaatagctcggctgtgtggctatgatgtccccacccctgtgctgagcccctccagcatcatgctcatcagcttccaatcagatgaaaacgggacctgcaggggctttcaggctacagtctccttcattcctaaagcaggtaagaagatagagttaccaactctttggttcccagttctaatccttgtgatgtga

SEQ ID NO: 293 - protein, 564 aa, Homo sapiens
MLISRNKLILLLGIVFFERGKSATLSLPKAPSCGQSLVKVQPWNYFNIFSRILGGSQVEKGSYPWQVSLKQRQKHICGGSIVSPQWVITAAHCIANRNIVSTLNVTAGEYDLSQTDPGEQTLTIETVIIHPHFSTKKPMDYDIALLKMAGAFQFGHFVGPICLPELREQFEAGFICTTAGWGRLTEGGVLSQVLQEVNLPILTWEECVAALLTLKRPISGKTFLCTGFPDGGRDACQGDSGGSLMCRNKKGAWTLAGVTSWGLGCGRGWRNNVRKSDQGSPGIFTDISKVLPWIHEHIQTGNRRKSSRAWCSEQDVIVSGAEGKLHFPESLHLYYESKQRCVWTLLVPEEMHVLLSFSHLDVESCHHSYLSMYSLEDRPIGKFCGESLPSSILIGSNSLRLKFVSDATDYAAGFNLTYKALKPNYIPDSGCSYLTVLFEEGLIQSLNYPENYSDKANCDWIFQASKHHLIKLSFQSLEIEESGDCTSDYVTVHSDVERKKEIARLCGYDVPTPVLSPSSIMLISFQSDENGTCRGFQATVSFIPKAGKKIELPTLWFPVLILVM

SEQ ID NO: 294 - DNA, 3420 bp, Homo sapiens
atgggcctgctggccagtgctggtttgttgctgttgctggtcatcggccaccccagaagcctaggactgaagtgtggaattcgcatggtcaacatgaaaagtaaggaacctgccgtgggatctagattcttctctagaattagtagttggagaaattcaacagtgactggacatccatggcaggtctccctaaaatcagatgagcaccacttctgtggaggaagcttgattcaagaagatcgggttgttacagcagcacactgcctggacagcctcagtgagaagcagctgaagaatataactgtgacttctggggagtacagcctctttcagaaggataagcaagaacagaatattcctgtctcaaaaattattacccatcctgaatacaacagccgtgaatatatgagtcctgatattgcactgctgtatctaaaacacaaagtcaagtttggaaatgctgttcagccaatctgtcttcctgacagcgatgataaagttgaaccaggaattctttgcttatccagtggatggggcaagatttccaaaacatcagaatattcaaatgtcctacaagaaatggaacttcccatcatggatgacagagcgtgtaatactgtgctcaagagcatgaacctccctcccctgggaaggaccatgctgtgtgctggcttccctgattggggaatggacgcctgccagggggactctggaggaccactggtttgtagaagaggtggtggaatctggattcttgctgggataacttcctgggtagctggttgtgctggaggttcagttcccgtaagaaacaaccatgtgaaggcatcacttggcattttctccaaagtgtctgagttgatggattttatcactcaaaacctgttcacaggtttggatcggggccaacccctctcaaaagtgggctcaaggtatataacaaaggccctgagttctgtccaagaagtgaatggaagccagagaggaaagggtattttagacatggaaaagcaagttggatgtgatcatgactatgtatctttacgatcaagcagtggagtgctttttaatcagagatctctcatggaagacgatggaaaacaaaacaaacgtgtctgtggaaaaatattgccttcaccattgctggcagagaccagtgaggccatggttccatttgtttctgatacagaagacagtggcagtggctttgagcttaccgttactgctgtacagaagtcagaagcagggtcaggttgtgggagtctggctatattggtagaagaagggacaaatcactctgccaagtatcctgatttgtatcccagtaacacaaggtgtcattggttcatttgtgctccagagaagcacattataaagttgacatttgaggactttgctgtcaaatttagtccaaactgtatttatgatgctgttgtgatttacggtgattctgaagaaaagcacaagttagctaaactttgtggaatgttgaccatcacttcaatattcagttctagtaacatgacggtgatatactttaaaagtgatggtaaaaatcgtttacaaggcttcaaggccagatttaccattttgccctcagagtctttaaacaaatttgaaccaaagttacctccccaaaacaatcctgtatctaccgtaaaagctattctgcatgatgtctgtggcatccctccatttagtccccagtggctttccagaagaatcgcaggaggggaagaagcctgcccccactgttggccatggcaggtgggtctgaggtttctaggcgattaccaatgtggaggtgccatcatcaacccagtgtggattctgaccgcagcccactgtgtgcaattgaagaataatccactctcctggactattattgctggggaccatgacagaaacctgaaggaatcaacagagcaggtgagaagggccaaacacataatagtgcatgaagactttaacacactaagttatgactctgacattgccctaatacaactaagctctcctctggagtacaactcggtggtgaggccagtatgtctcccacacagcgcagagcctctattttcctcggagatctgtgctgtgaccggatggggaagcatcagtgcagatggtggcctagcaagtcgcctacagcagattcaagtgcatgtgttagaaagagaggtctgtgaacacacttactattctgcccatccaggagggatcacagagaagatgatctgtgctggctttgcagcatctggagagaaagatttctgccagggagactctggtgggccactagtatgtagacatgaaaatggtccctttgtcctctatggcattgtcagctggggagctggctgtgtccagccatggaagccgggtgtatttgccagagtgatgatcttcttggactggatccaatcaaaaatcaatggtcctgcttcacttcagacaaataataaatgcaaaaccttaaaacaacaattgccaccacccacaccttcaccagacagtgcatcttggccaggttgttgctctgaagcagagctagaaaagcctagaggcttttttcccacaccacggtatctactggattatagaggaagactggaatgttcttgggtgctcagagtttcagcaagcagtatggcaaaatttaccattgagtatctgtcactcctggggtctcctgtgtgtcaagactcagttctaattatttatgaagaaagacacagtaagagaaagacggcaggtggattacatggaagaagactttactcaatgactttcatgagtcctggaccgctggtgagggtgacattccatgcccttgtacgaggtgcatttggtataagctatattgacttgaaagtcctaggtccaaaggacagtaaaataaccagactttcccaaagttcaaacagagagcacttggtcccttgtgaggatgttcttctgaccaagccagaagggatcatgcagatcccaagaaattctcacagaactactatggggtgccaatggagattagtagcccctttaaatcacatcattcagcttaatattattaacttcccgatgaagccaacaacttttgtctgtcatggtcatctgcgtgtttacgaaggatttggaccaggaaaaaaattaatagcttcattcgctggaactctggcaatgatactgacaaaagacatattaaaaagagaaaaactgaattttattaacacatatatcatgcatatatgggaaaattcagtgtatgataatgtaagaagtgttggaaaaagaaaacagaagaaatttgcatcaaatttaagttatagtatggaggctgagaagtccaggatccaggtgccagcagatttggtgcctgctaagggctcactttctggttcttaggcacagcccattctc

SEQ ID NO: 295 - protein, 1134 aa, Homo sapiens
MGLLASAGLLLLLVIGHPRSLGLKCGIRMVNMKSKEPAVGSRFFSRISSWRNSTVTGHPWQVSLKSDEHHFCGGSLIQEDRVVTAAHCLDSLSEKQLKNITVTSGEYSLFQKDKQEQNIPVSKIITHPEYNSREYMSPDIALLYLKHKVKFGNAVQPICLPDSDDKVEPGILCLSSGWGKISKTSEYSNVLQEMELPIMDDRACNTVLKSMNLPPLGRTMLCAGFPDWGMDACQGDSGGPLVCRRGGGIWILAGITSWVAGCAGGSVPVRNNHVKASLGIFSKVSELMDFITQNLFTGLDRGQPLSKVGSRYITKALSSVQEVNGSQRGKGILDMEKQVGCDHDYVSLRSSSGVLFNQRSLMEDDGKQNKRVCGKILPSPLLAETSEAMVPFVSDTEDSGSGFELTVTAVQKSEAGSGCGSLAILVEEGTNHSAKYPDLYPSNTRCHWFICAPEKHIIKLTFEDFAVKFSPNCIYDAVVIYGDSEEKHKLAKLCGMLTITSIFSSSNMTVIYFKSDGKNRLQGFKARFTILPSESLNKFEPKLPPQNNPVSTVKAILHDVCGIPPFSPQWLSRRIAGGEEACPHCWPWQVGLRFLGDYQCGGAIINPVWILTAAHCVQLKNNPLSWTIIAGDHDRNLKESTEQVRRAKHIIVHEDFNTLSYDSDIALIQLSSPLEYNSVVRPVCLPHSAEPLFSSEICAVTGWGSISADGGLASRLQQIQVHVLEREVCEHTYYSAHPGGITEKMICAGFAASGEKDFCQGDSGGPLVCRHENGPFVLYGIVSWGAGCVQPWKPGVFARVMIFLDWIQSKINGPASLQTNNKCKTLKQQLPPPTPSPDSASWPGCCSEAELEKPRGFFPTPRYLLDYRGRLECSWVLRVSASSMAKFTIEYLSLLGSPVCQDSVLIIYEERHSKRKTAGGLHGRRLYSMTFMSPGPLVRVTFHALVRGAFGISYIDLKVLGPKDSKITRLSQSSNREHLVPCEDVLLTKPEGIMQIPRNSHRTTMGCQWRLVAPLNHIIQLNIINFPMKPTTFVCHGHLRVYEGFGPGKKLIASFAGTLAMILTKDILKREKLNFINTYIMHIWENSVYDNVRSVGKRKQKKFASNLSYSMEAEKSRIQVPADLVPAKGSLSGS

SEQ ID NO: 296 - DNA, 2810 bp, Homo sapiens
acttggctctgcctccgctgactctagcgccatggcccggcacctgctcctcccccttgtgatgcttgtcatcagtcccatcccaggagccttccaggactcagctctcagtcctacccaggaagaacctgaagatctggactgcgggcgccctgagccctcggcccgcatcgtgggggggctcaaacgcgcagccgggcacctggccttggcaagtgagcctgcaccatggaggtggccacatctgcgggggctccctcatcgccccctcctgggtcctctccgctgctcactgtttcatgacgaatgggacgctggagcccgcggccgagtggtcggtactgctgggcgtgcactcccaggacgggcccctggacggcgcgcacacccgcgcagtggccgccatcgtggtgccggccaactacagccaagtggagctgggcgccgacctggccctgctgcgcctggcctcacccgccagcctgggccccgccgtgtggcctgtctgcctgccccgcgcctcacaccgcttcgtgcacggcaccgcctgctgggccaccggctggggagacgtccaggaggcagatcctctgcctctcccctgggtgctacaggaagtggagctaaggctgctgggcgaggccacctgtcaatgtctctacagccagcccggtcccttcaacctcactctccagatattgccagggatgctgtgtgctggctacccagagggccgcagggacacctgccagggcgactctggggggcccctggtctgtgaggaaggcggccgctggttccaggcaggaatcaccagctttggctttggctgtggacggagaaaccgccctggagttttcactgctgtggctacctatgaggcatggatacgggagcaggtgatgggttcagagcctgggcctgcctttcccacccagccccagaagacccagtcagatccccaggagcccagggaggagaactgcaccattgccctgcctgagtgcgggaaggccccgcggccaggggcctggccctgggaggcccaggtgatggtgccaggatccagaccctgccatggggcgctggtgtctgaaagctgggtcttggcacctgccagctgctttctggacccgaacagctccgacagcccaccccgcgacctcgacgcctggcgcgtgctgctgccctcgcgcccgcgcgcggagcgggtggcgcgcctggtgcagcacgagaacgcttcgtgggacaacgcctcggacctggcgctgctgcagctgcgcacgcccgtgaacctgagtgcggcttcgcggcccgtgtgcctaccccacccggaacactacttcctgcccgggagccgctgccgcctggcccgctggggccgcggggaacccgcgcttggcccaggcgcgctgctggaggcggagctgttaggcggctggtggtgccactgcctgtacggccgccagggggcggcagtaccgctgcccggagacccgccgcacgcgctctgccctgcctaccaggaaaaggaggaggtgggcagctgctggaatgactcgcgttggagccttttgtgccaggaggaggggacctggtttctggctggaatcagagactttcccagtggctgtctacgtccccgagccttcttccctctgcagactcatggcccatggatcagccatgtgactcggggagcctacctggaggaccagctagcctgggactggggccctgatggggaggagactgagacacagacttgtcccccacacacagagcatggtgcctgtggcctgcggctggaggctgctccagtgggggtcctgtggccctggctggcagaggtgcatgtggctggtgatcgagtctgcactgggatcctcctggccccaggctgggtcctggcagccactcactgtgtcctcaggccaggctctacaacagtgccttacattgaagtgtatctgggccgggcaggggccagctccctcccacagggccaccaggtatcccgcttggtcatcagcatccggctgccccagcacctgggactcaggccccccctggccctcctggagctgagctcccgggtggagccctccccatcagccctgcccatctgtctccacccggcgggtatccccccgggggccagctgctgggtgttgggctggaaagaaccccaggaccgagtccctgtggctgctgctgtctccatcttgacacaacgaatctgtgactgcctctatcagggcatcctgccccctggaaccctctgtgtcctgtatgcagaggggcaggagaacaggtgtgagatgacctcagcaccgcccctcctgtgccagatgacggaagggtcctggatcctcgtgggcatggctgttcaagggagccgggagctgtttgctgccattggtcctgaagaggcctggatctcccagacagtgggagaggccaacctcctgccccccagtggctccccacactggcccactggaggcagcaatctctgccccccagaactggccaaggcctcgggatccccgcatgcagtctacttcctgctcctgctgactctcctgatccagagctgaggggctagggtcccagcaccacttcccccttctccaccctctacttcccgcccagtggggctggaatgtggcccagccggctggaacctcaagggccccacccaccgagattgcagcggctctggctaattgggcctctgtgcccgggctattttgaacccaggaatccttgggggtggtgggaggagcggacaataaaggtgtaaacac

SEQ ID NO: 297 - protein, 766 aa, Homo sapiens
MTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGGRWFQAGITSFGFGCGRRNRPGVFTAVATYEAWIREQVMGSEPGPAFPTQPQKTQSDPQEPREENCTIALPECGKAPRPGAWPWEAQVMVPGSRPCHGALVSESWVLAPASCFLDPNSSDSPPRDLDAWRVLLPSRPRAERVARLVQHENASWDNASDLALLQLRTPVNLSAASRPVCLPHPEHYFLPGSRCRLARWGRGEPALGPGALLEAELLGGWWCHCLYGRQGAAVPLPGDPPHALCPAYQEKEEVGSCWNDSRWSLLCQEEGTWFLAGIRDFPSGCLRPRAFFPLQTHGPWISHVTRGAYLEDQLAWDWGPDGEETETQTCPPHTEHGACGLRLEAAPVGVLWPWLAEVHVAGDRVCTGILLAPGWVLAATHCVLRPGSTTVPYIEVYLGRAGASSLPQGHQVSRLVISIRLPQHLGLRPPLALLELSSRVEPSPSALPICLHPAGIPPGASCWVLGWKEPQDRVPVAAAVSILTQRICDCLYQGILPPGTLCVLYAEGQENRCEMTSAPPLLCQMTEGSWILVGMAVQGSRELFAAIGPEEAWISQTVGEANLLPPSGSPHWPTGGSNLCPPELAKASGSPHAVYFLLLLTLLIQS

SEQ ID NO: 298 - protein, 245 aa, Homo sapiens
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDPKKGHIYQGSEADSVFSGFLIFPSA

SEQ ID NO: 299 - protein, 251 aa, Homo sapiens
MKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 300 - protein, 245 aa, Homo sapiens
MDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVKVVTFCGHTSKTNQVNSGGVLLRLQVGEEVWLAVNDYYDMVGIQGSDSVFSGFLLFPD

SEQ ID NO: 301 - DNA, 2526 bp, Homo sapiens
gcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaattaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtgcaaaaaaaaaaaaaaaaaaaaaaaaaaaaaa

SEQ ID NO: 302 - protein, 705 aa, Homo sapiens
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 303 - DNA, 2714 bp, Homo sapiens
aatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaaaaaaaaaaaaaaaaaaaaaaaaaaaaaaaaa

SEQ ID NO: 304 - protein, 688 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 305 - protein, 252 aa, Homo sapiens
MFFWCACCLMVAWRVSASDAEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRDCDPPGNPVHGYFEGNNFTLGSTISYYCEDRYYLVGVQEQQCVDGEWSSALPVCKLIQEAPKPECEKALLAFQESKNLCEAMENFMQQLKESGMTMEELKYSLELKKAELKAKLL

SEQ ID NO: 306 - protein, 597 aa, Homo sapiens
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTSRCEVQDRGVGWSHPLPQCEIVKCKPPPDIRNGRHSGEENFYAYGFSVTYSCDPRFSLLGHASISCTVENETIGVWRPSPPTCEKITCRKPDVSHGEMVSGFGPIYNYKDTIVFKCQKGFVLRGSSVIHCDADSKWNPSPPACEPNSCINLPDIPHASWETYPRPTKEDVYVVGTVLRYRCHPGYKPTTDEPTTVICQKNLRWTPYQGCEALCCPEPKLNNGEITQHRKSRPANHCVYFYGDEISFSCHETSRFSAICQGDGTWSPRTPSCGDICNFPPKIAHGHYKQSSSYSFFKEEIIYECDKGYILVGQAKLSCSYSHWSAPAPQCKALCRKPELVNGRLSVDKDQYVEPENVTIQCDSGYGVVGPQSITCSGNRTWYPEVPKCEWETPEGCEQVLTGKRLMQCLPNPEDVKMALEVYKLSLEIEQLELQRDSARQSTLDKEL

SEQ ID NO: 307 - DNA, 1963 bp, Homo sapiens
cgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtggctcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtttttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcattggatatttttaaaggtctccacagagtttatgccatattggaattttgttgtataattctcaaataaatattttggtgaagcat

SEQ ID NO: 308 - protein, 583 aa, Homo sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAGFASVAQEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 309 - protein, 449 aa, Homo sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 310 - DNA, 2609 bp, Homo sapiens
ggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccac

SEQ ID NO: 311 - protein, 752 aa, Homo sapiens
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 312 - protein, 1663 aa, Homo sapiens
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNLRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 313 - protein, 1744 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALSLTKAPVDLLGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 314 - protein, 1676 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVILNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGIGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 315 - protein, 934 aa, Homo sapiens
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTEPLVAFQPCIPSKLCKIEEADCKNKFRCDSGRCIARKLECNGENDCGDNSDERDCGRTKAVCTRKYNPIPSVQLMGNGFHFLAGEPRGEVLDNSFTGGICKTVKSSRTSNPYRVPANLENVGFEVQTAEDDLKTDFYKDLTSLGHNENQQGSFSSQGGSSFSVPIFYSSKRSENINHNSAFKQAIQASHKKDSSFIRIHKVMKVLNFTTKAKDLHLSDVFLKALNHLPLEYNSALYSRIFDDFGTHYFTSGSLGGVYDLLYQFSSEELKNSGLTEEEAKHCVRIETKKRVLFAKKTKVEHRCTTNKLSEKHEGSFIQGAEKSISLIRGGRSEYGAALAWEKGSSGLEEKTFSEWLESVKENPAVIDFELAPIVDLVRNIPCAVTKRNNLRKALQEYAAKFDPCQCAPCPNNGRPTLSGTECLCVCQSGTYGENCEKQSPDYKSNAVDGQWGCWSSWSTCDATYKRSRTRECNNPAPQRGGKRCEGEKRQEEDCTFSIMENNGQPCINDDEEMKEVDLPEIEADSGCPQPVPPENGFIRNEKQLYLVGEDVEISCLTGFETVGYQYFRCLPDGTWRQGDVECQRTECIKPVVQEVLTITPFQRLYRIGESIELTCPKGFVVAGPSRYTCQGNSWTPPISNSLTCEKDTLTKLKGHCQLGQKQSGSECICMSPEEDCSHHSEDLCVFDTDSNDYFTSPACKFLAEKCLNNQQLHFLHIGSCQDGRQLEWGLERTRLSSNSTKKESCGYDTCYDWEKCSASTSKCVCLLPPQCFKGGNQLYCVKMGSSTSEKTLNICEVGTIRCANRKMEILHPGKCLA

SEQ ID NO: 316 - protein, 843 aa, Homo sapiens
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGYNELTGQFRNRVINTKSFGGQCRKVFSGDGKDFYRLSGNVLSYTFQVKINNDFNYEFYNSTWSYVKHTSTEHTSSSRKRSFFRSSSSSSRSYTSHTNEIHKGKSYQLLVVENTVEVAQFINNNPEFLQLAEPFWKELSHLPSLYDYSAYRRLIDQYGTHYLQSGSLGGEYRVLFYVDSEKLKQNDFNSVEEKKCKSSGWHFVVKFSSHGCKELENALKAASGTQNNVLRGEPFIRGGGAGFISGLSYLELDNPAGNKRRYSAWAESVTNLPQVIKQKLTPLYELVKEVPCASVKKLYLKWALEEYLDEFDPCHCRPCQNGGLATVEGTHCLCHCKPYTFGAACEQGVLVGNQAGGVDGGWSCWSSWSPCVQGKKTRSRECNNPPPSGGGRSCVGETTESTQCEDEELEHLRLLEPHCFPLSLVPTEFCPSPPALKDGFVQDEGTMFPVGKNVVYTCNEGYSLIGNPVARCGEDLRWLVGEMHCQKIACVLPVLMDGIQSHPQKPFYTVGEKVTVSCSGGMSLEGPSAFLCGSSLKWSPEMKNARCVQKENPLTQAVPKCQRWEKLQNSRCVCKMPYECGPSLDVCAQDERSKRILPLTVCKMHVLHCQGRNYTLTGRDSCTLPASAEKACGACPLWGKCDAESSKCVCREASECEEEGFSICVEVNGKEQTMSECEAGALRCRGQSISVTSIRPCAAETQ

SEQ ID NO: 317 - protein, 584 aa, Homo sapiens
MFAVVFFILSLMTCQPGVTAQEKVNQRVRRAATPAAVTCQLSNWSEWTDCFPCQDKKYRHRSLLQPNKFGGTICSGDIWDQASCSSSTTCVRQAQCGQDFQCKETGRCLKRHLVCNGDQDCLDGSDEDDCEDVRAIDEDCSQYEPIPGSQKAALGYNILTQEDAQSVYDASYYGGQCETVYNGEWRELRYDSTCERLYYGDDEKYFRKPYNFLKYHFEALADTGISSEFYDNANDLLSKVKKDKSDSFGVTIGIGPAGSPLLVGVGVSHSQDTSFLNELNKYNEKKFIFTRIFTKVQTAHFKMRKDDIMLDEGMLQSLMELPDQYNYGMYAKFINDYGTHYITSGSMGGIYEYILVIDKAKMESLGITSRDITTCFGGSLGIQYEDKINVGGGLSGDHCKKFGGGKTERARKAMAVEDIISRVRGGSSGWSGGLAQNRSTITYRSWGRSLKYNPVVIDFEMQPIHEVLRHTSLGPLEAKRQNLRRALDQYLMEFNACRCGPCFNNGVPILEGTSCRCQCRLGSLGAACEQTQTEGAKADGSWSCWSSWSVCRAGIQERRRECDNPAPQNGGASCPGRKVQTQAC

SEQ ID NO: 318 - protein, 591 aa, Homo sapiens
MKNSRTWAWRAPVELFLLCAALGCLSLPGSRGERPHSFGSNAVNKSFAKSRQMRSVDVTLMPIDCELSSWSSWTTCDPCQKKRYRYAYLLQPSQFHGEPCNFSDKEVEDCVTNRPCRSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 319 - protein, 202 aa, Homo sapiens
MLPPGTATLLTLLLAAGSLGQKPQRPRRPASPISTIQPKANFDAQQFAGTWLLVAVGSACRFLQEQGHRAEATTLHVAPQGTAMAVSTFRKLDGICWQVRQLYGDTGVLGRFLLQARGARGAVHVVVAETDYQSFAVLYLERAGQLSVKLYARSLPVSDSVLSGFEQRVQEAHLTEDQIFYFPKYGFCEAADQFHVLDEVRR

SEQ ID NO: 320 - protein, 559 aa, Homo sapiens
MSACRSFAVAICILEISILTAQYTTSYDPELTESSGSASHIDCRMSPWSEWSQCDPCLRQMFRSRSIEVFGQFNGKRCTDAVGDRRQCVPTEPCEDAEDDCGNDFQCSTGRCIKMRLRCNGDNDCGDFSDEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 321 - protein, 2039 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFSLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYTCDPGYLLVGKGFIFCTDQGIWSQLDHYCKEVNCSFPLFMNGISKELEMKKVYHYGDYVTLKCEDGYTLEGSPWSQCQADDRWDPPLAKCTSRAHDALIVGTLSGTIFFILLIIFLSWIILKHRKGNNAHENPKEVAIHLHSQGGSSVHPRTLQTNEENSRVLP

SEQ ID NO: 322 - protein, 1033 aa, Homo sapiens [sequence omitted]

SEQ ID NO: 323 - protein, 381 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 324 - protein, 500 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 325 - DNA, 4353 bp, Homo sapiens
gaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagtgtgtgggctccccaagttctcccggaagctgatggccaggatcttcaatggacgcccagcccagaaaggcaccactccctggattgccatgctgtcacacctgaatgggcagcccttctgcggaggctcccttctaggctccagctggatcgtgaccgccgcacactgcctccaccagtcactcgatccggaagatccgaccctacgtgattcagacttgctcagcccttctgacttcaaaatcatcctgggcaagcattggaggctccggtcagatgaaaatgaacagcatctcggcgtcaaacacaccactctccacccccagtatgatcccaacacattcgagaatgacgtggctctggtggagctgttggagagcccagtgctgaatgccttcgtgatgcccatctgtctgcctgagggaccccagcaggaaggagccatggtcatcgtcagcggctgggggaagcagttcttgcaaaggttcccagagaccctgatggagattgaaatcccgattgttgaccacagcacctgccagaaggcttatgccccgctgaagaagaaagtgaccagggacatgatctgtgctggggagaaggaagggggaaaggacgcctgtgcgggtgactctggaggccccatggtgaccctgaatagagaaagaggccagtggtacctggtgggcactgtgtcctggggtgatgactgtgggaagaaggaccgctacggagtatactcttacatccaccacaacaaggactggatccagagggtcaccggagtgaggaactgaatttggctcctcagccccagcaccaccagctgtgggcagtcagtagcagaggacgatcctccgatgaaagcagccatttctcctttccttcctcccatcccccctccttcggcctatccattactgggcaatagagcaggtatcttcacccccttttcactctctttaaagagatggagcaagagagtggtcagaacacaggccgaatccaggctctatcacttactagtttgcagtgctgggcaggtgacttcatctcttcgaacttcagtttcttcataagatggaaatgctataccttacctacctcgtaaaagtctgatgaggaaaagattaactaatagatgcatagcacttaacagagtgcatagcatacactgttttcaataaatgcaccttagcagaaggtcgatgtgtctaccaggcagacgaagctctcttacaaacccctgcctgggtcttagcattgatcagtgacacacctctcccctcaaccttgaccatctccatctgcccttaaatgctgtatgcttttttgccaccgtgcaacttgcccaacatcaatcttcaccctcatccctaaaaaagtaaaacagacaaggttctgagtcctgtggtatgtcccctagcaaatgtaactaggaacatgcactagatgacagattgcgggagggcctgagagaagcagggacaggagggagcctggggattgtggtttgggaaggcagacacctggttctagaactagctctgcccttagccccctgtatgaccctatgcaagtcctcctccctcatctcaaagggtcctcaaagctctgacgatctaagatacaatgaagccattttccccctgataagatgaggtaaagccaatgtaaccaaaaggcaaaaattacaatcggttcaaaggaactttgatgcagacaaaatgctgctgctgctgctcctgaaatacccacccctttccactacgggtgggttcccaaggacatgggacaggcaaagtgtgagccaaaggatccttccttattcctaagcagagcatctgctctgggccctggcctccttcccttcttgggaaactgggctgcatgaggtgggccctggtagtttgtaccccaggcccctatactcttccttcctatgtccacagctgaccccaagcagccgttccccgactcctcacccctgagcctcaccctgaactccctcatcttgcaaggccataagtgttttccaagcaaaatgcctctcccatcctctctcaggaagcttctagagactttatgccctccagagctccaagatataagccctccaagggatcagaagctccaagttcctgtcttctgttttatagaaattgatcttccctgggggactttaactcttgacctgtatgcagctgttggagtaattccaggtctcttgaaaaaaaagaggaagataatggagaatgagaacatatatatatatatattaagccccaggctgaatactcagggacagcaattcacagcctgcctctggttctataaacaagtcattctacctctttgtgccctgctgtttattctgtaaggggaaggtggcaatgggacccagctccatcagacacttgtcaagctagcagaaactccattttcaatgccaaagaagaactgtaatgctgttttggaatcatcccaaggcatcccaagacaccatatcttcccatttcaagcactgcctgggcacaccccaacatcccaggctgtggtggctcctgtgggaactacctagatgaagagagtatcatttataccttctaggagctcctattgggagacatgaaacatatgtaattgactaccatgtaatagaacaaaccctgccaagtgctgctttggaaagtcatggaggtaaaagaaagaccattc

SEQ ID NO: 326 - protein, 699 aa, Homo sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIQDHPEVPCPYDYIKIKVGPKVLGPFCGEKAPEPISTQSHSVLILFHSDNSAENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPVCGLPKFSRKLMARIFNGRPAQKGTTPWIAMLSHLNGQPFCGGSLLGSSWIVTAAHCLHQSLDPKDPTLRDSDLLSPSDFKIILGKHWRLRSDENEQHLGVKHTTLHPQYDPNTFENDVALVELLESPVLNAFVMPICLPEGPQQEGAMVIVSGWGKQFLQRFPETLMEIEIPIVDHSTCQKAYAPLKKKVTRDMICAGEKEGGKDACAGDSGGPMVTLNRERGQWYLVGTVSWGDDCGKKDRYGVYSYIHHNKDWIQRVTGVRN

SEQ ID NO: 327 - DNA, 4137 bp, Homo sapiens
gaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccactttctcaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaaaaaaaaaaaaaaaaaaaa

SEQ ID NO: 328 - protein, 728 aa, Homo sapiens; identical to SEQ ID NO: 136

SEQ ID NO: 329 - DNA, 2072 bp, Homo sapiens
gaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacactattccagaaaataatgaaaaaaaaatgtgggatttattttagcacctctgagtggactgtacttttctcaacggaaaaaaaaaatgcccttggtccttgagacaaaagatttaatatacaaccatgtggcctcaggctgaccagatcaaagtggtttctaatccattctacatgtcaagtttaaatgaaccagactgcctgtgactttatgaatctgaaggtattacctgttgctgctttcttaaccaccatgagtaggtaaagcaaataataactcacagagtgtggatttttgagaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 330 - protein, 380 aa, Homo sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 331 - DNA, 2460 bp, Homo sapiens
ggccagctggacgggcacaccatgaggctgctgaccctcctgggccttctgtgtggctcggtggccacccccttgggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggacattgacgagtgccaggtggccccgggagaggcgcccacctgcgaccaccactgccacaaccacctgggcggtttctactgctcctgccgcgcaggctacgtcctgcaccgtaacaagcgcacctgctcagccctgtgctccggccaggtcttcacccagaggtctggggagctcagcagccctgaatacccacggccgtatcccaaactctccagttgcacttacagcatcagcctggaggaggggttcagtgtcattctggactttgtggagtccttcgatgtggagacacaccctgaaaccctgtgtccctacgactttctcaagattcaaacagacagagaagaacatggcccattctgtgggaagacattgccccacaggattgaaacaaaaagcaacacggtgaccatcacctttgtcacagatgaatcaggagaccacacaggctggaagatccactacacgagcacagcgcagccttgcccttatccgatggcgccacctaatggccacgtttcacctgtgcaagccaaatacatcctgaaagacagcttctccatcttttgcgagactggctatgagcttctgcaaggtcacttgcccctgaaatcctttactgcagtttgtcagaaagatggatcttgggaccggccaatgcccgcgtgcagcattgttgactgtggccctcctgatgatctacccagtggccgagtggagtacatcacaggtcctggagtgaccacctacaaagctgtgattcagtacagctgtgaagagaccttctacacaatgaaagtgaatgatggtaaatatgtgtgtgaggctgatggattctggacgagctccaaaggagaaaaatcactcccagtctgtgagcctgtttgtggactatcagcccgcacaacaggagggcgtatatatggagggcaaaaggcaaaacctggtgattttccttggcaagtcctgatattaggtggaaccacagcagcaggtgcacttttatatgacaactgggtcctaacagctgctcatgccgtctatgagcaaaaacatgatgcatccgccctggacattcgaatgggcaccctgaaaagactatcacctcattatacacaagcctggtctgaagctgtttttatacatgaaggttatactcatgatgctggctttgacaatgacatagcactgattaaattgaataacaaagttgtaatcaatagcaacatcacgcctatttgtctgccaagaaaagaagctgaatcctttatgaggacagatgacattggaactgcatctggatggggattaacccaaaggggttttcttgctagaaatctaatgtatgtcgacataccgattgttgaccatcaaaaatgtactgctgcatatgaaaagccaccctatccaaggggaagtgtaactgctaacatgctttgtgctggcttagaaagtgggggcaaggacagctgcagaggtgacagcggaggggcactggtgtttctagatagtgaaacagagaggtggtttgtgggaggaatagtgtcctggggttccatgaattgtggggaagcaggtcagtatggagtctacacaaaagttattaactatattccctggatcgagaacataattagtgatttttaacttgcgtgtctgcagtcaaggattcttcatttttagaaatgcctgtgaagaccttggcagcgacgtggctcgagaagcattcatcattactgtggacatggcagttgttgctccacccaaaaaaacagactccaggtgaggctgctgtcatttctccacttgccagtttaattccagccttacccattgactcaaggggacataaaccacgagagtgacagtcatctttgcccacccagtgtaatgtcactgctcaaattacatttcattaccttaaaaagccagtctcttttcatactggctgttggcatttctgtaaactgcctgtccatgctctttgtttttaaacttgttcttattgaaaaaaaaaaaaaaaaa

SEQ ID NO: 332 - protein, 686 aa, Homo sapiens [sequence omitted]

SEQ ID NO: 333 - DNA, 738 bp, Homo sapiens
ggccagctggacgggcacaccatgaggctgctgaccctcctgggccttctgtgtggctcggtggccacccccttgggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggacattgacgagtgccaggtggccccgggagaggcgcccacctgcgaccaccactgccacaaccacctgggcggtttctactgctcctgccgcgcaggctacgtcctgcaccgtaacaagcgcacctgctcagagcagagcctctagcctcccctggagctccggcctgcccagcaggtcagaagccagagccagcctgctggcctcagctccgggttgggctgagatggctgtgccccaactcccattcacccaccatggacccaataataaacctggccccaccccaaaaaaaaaaaaaaaaaa

SEQ ID NO: 334 - protein, 185 aa, Homo sapiens
MRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSEQSL

SEQ ID NO: 335 - protein, 248 aa, Homo sapiens
MSLFPSLPLLLLSMVAASYSETVTCEDAQKTCPAVIACSSPGINGFPGKDGRDGTKGEKGEPGQGLRGLQGPPGKLGPPGNPGPSGSPGPKGQKGDPGKSPDGDSSLAASERKALQTEMARIKKWLTFSLGKQVGNKFFLTNGEIMTFEKVKALCVKFQASVATPRNAAENGAIQNLIKEEAFLGITDEKTEGQFVDLTGNRLTYTNWNEGEPNNAGSDEDCVLLLKNGQWNDVPCSTSHLAVCEFPI

SEQ ID NO: 336 - protein, 392 aa, Homo sapiens [sequence omitted]

SEQ ID NO: 337 - DNA, 2574 bp, Homo sapiens
ttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaac

SEQ ID NO: 338 - protein, 764 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 339 - DNA, 1173 bp, Homo sapiens
gtgtctcagccacagcggcttcaccatgcacagctgggagcgcctggcagttctggtcctcctaggagcggccgcctgcgcggcgccgccccgtggtcggatcctgggcggcagagaggccgaggcgcacgcgcggccctacatggcgtcggtgcagctgaacggcgcgcacctgtgcggcggcgtcctggtggcggagcagtgggtgctgagcgcggcgcactgcctggaggacgcggccgacgggaaggtgcaggttctcctgggcgcgcactccctgtcgcagccggagccctccaagcgcctgtacgacgtgctccgcgcagtgccccacccggacagccagcccgacaccatcgaccacgacctcctgctgctacagctgtcggagaaggccacactgggccctgctgtgcgccccctgccctggcagcgcgtggaccgcgacgtggcaccgggaactctctgcgacgtggccggctggggcatagtcaaccacgcgggccgccgcccggacagcctgcagcacgtgctcttgccagtgctggaccgcgccacctgcaaccggcgcacgcaccacgacggcgccatcaccgagcgcttgatgtgcgcggagagcaatcgccgggacagctgcaagggtgactccgggggcccgctggtgtgcgggggcgtgctcgagggcgtggtcacctcgggctcgcgcgtttgcggcaaccgcaagaagcccgggatctacacccgcgtggcgagctatgcggcctggatcgacagcgtcctggcctagggtgccggggcctgaaggtcagggtcacccaagcaacaaagtcccgagcaatgaagtcatccactcctgcatctggttggtctttattgagcacctactatatgcagaaggggaggccgaggtgggaggatcattggatctcaggagttcgagatcagcatgggccacgtagcgcgactccatctctacaaataaataaaaaattagctgggcaattggcgggcatggaggtgggtgcttgtagttccagctactcaggaggctgaggtgggaggatgacttgaacgcaggaggctgaggctgcagtgagttgtgattgcaccactgccctccagcctgggcaacagagtgaaaccttgtctctctctacaaaaaaaaaaaaaaaa

SEQ ID NO: 340 - protein, 253 aa, Homo sapiens
MHSSVYFAVLVLLGAAACAARPRGRILGGREAEAHARPYMASVQLNGAHLCGGVLVAEQWVLSAAHCLEDAADGKVQVLLGAHSLSQPEPSKRLYDVLRAVPHPDSQPDTIDHDLLLLQLSEKATLGPAVRPLPWQRVDRDVAPGTLCDVAGWGIVNHAGRRPDSLQHVLLPVLDRATCNRRTHHDGAITERLMCAESNRRDSCKGDSGGPLVCGGVLEGVVTSGSRVCGNRKKPGIYTRVASYAAWIDSVLA

SEQ ID NO: 341 - DNA, 4004 bp, Homo sapiens
ccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataaaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaaaaaaaaaaaa

SEQ ID NO: 342 - protein, 1231 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNHGRKFVQGKSIDVACHPGYALPKAQTTVTCMENGWSPTPRCIRVKTCSKSSIDIENGFISESQYTYALKEKAKYQCKLGYVTADGETSGSIRCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 343 - DNA, 1701 bp, Homo sapiens
gagcaccgcacactcacttcaccctggttcaacacccccacgaggttgaccccgtcattatgttagagattatgcattttccacatagggaaactgaggctcaggggtgttaagtgactcacccaaggtcacacggctaggaagttgctgcacgctcctatgctccatttcctctgggagcctatcaacccagataaagcgggacctcctctctggtagaggtgcagggggcagtactcaacatgatcacagagggagcgcaggcccctcgattgttgctgccgccgctgctcctgctgctcaccctgccagccacaggctcagaccccgtgctctgcttcacccagtatgaagaatcctccggcaagtgcaagggcctcctggggggtggtgtcagcgtggaagactgctgtctcaacactgcctttgcctaccagaaacgtagtggtgggctctgtcagccttgcaggtccccacgatggtccctgtggtccacatgggccccctgttcggtgacgtgctctgagggctcccagctgcggtaccggcgctgtgtgggctggaatgggcagtgctctggaaaggtggcacctgggaccctggagtggcagctccaggcctgtgaggaccagcagtgctgtcctgagatgggcggctggtctggctgggggccctgggagccttgctctgtcacctgctccaaagggacccggacccgcaggcgagcctgtaatcaccctgctcccaagtgtgggggccactgcccaggacaggcacaggaatcagaggcctgtgacacccagcaggtctgccccacacacggggcctgggccacctggggcccctggaccccctgctcagcctcctgccacggtggaccccacgaacctaaggagacacgaagccgcaagtgttctgcacctgagccctcccagaaacctcctgggaagccctgcccggggctagcctacgagcagcggaggtgcaccggcctgccaccctgcccagtggctgggggctgggggccttggggccctgtgagcccctgccctgtgacctgtggcctgggccagaccatggaacaacggacgtgcaatcaccctgtgccccagcatgggggccccttctgtgctggcgatgccacccggacccacatctgcaacacagctgtgccctgccctgtggatggggagtgggactcgtggggggagtggagcccctgtatccgacggaacatgaagtccatcagctgtcaagaaatcccgggccagcagtcacgcgggaggacctgcaggggccgcaagtttgacggacatcgatgtgccgggcaacagcaggatatccggcactgctacagcatccagcactgccccttgaaaggatcatggtcagagtggagtacctgggggctgtgcatgcccccctgtggacctaatcctacccgtgcccgccagcgcctctgcacacccttgctccccaagtacccgcccaccgtttccatggtcgaaggtcagggcgagaagaacgtgaccttctgggggagaccgctgccacggtgtgaggagctacaagggcagaagctggtggtggaggagaaacgaccatgtctacacgtgcctgcttgcaaagaccctgaggaagaggaactctaacacttctctcctccactctgagccccctgaccttccaaacctcaataaa

SEQ ID NO: 344 - protein, 469 aa, Homo sapiens
MITEGAQAPRLLLPPLLLLLTLPATGSDPVLCFTQYEESSGKCKGLLGGGVSVEDCCLNTAFAYQKRSGGLCQPCRSPRWSLWSTWAPCSVTCSEGSQLRYRRCVGWNGQCSGKVAPGTLEWQLQACEDQQCCPEMGGWSGWGPWEPCSVTCSKGTRTRRRACNHPAPKCGGHCPGQAQESEACDTQQVCPTHGAWATWGPWTPCSASCHGGPHEPKETRSRKCSAPEPSQKPPGKPCPGLAYEQRRCTGLPPCPVAGGWGPWGPVSPCPVTCGLGQTMEQRTCNHPVPQHGGPFCAGDATRTHICNTAVPCPVDGEWDSWGEWSPCIRRNMKSISCQEIPGQQSRGRTCRGRKFDGHRCAGQQQDIRHCYSIQHCPLKGSWSEWSTWGLCMPPCGPNPTRARQRLCTPLLPKYPPTVSMVEGQGEKNVTFWGRPLPRCEELQGQKLVVEEKRPCLHVPACKDPEEEEL

SEQ ID NO: 345 - DNA, 3462 bp, Artificial Sequence
  Vector: pQE32
ctcgagaaatcataaaaaatttatttgctttgtgagcggataacaattataatagattcaattgtgagcggataacaatttcacacagaattcattaaagaggagaaattaactatgagaggatctcaccatcaccatcaccatgggatccgcatgcgagctcggtaccccgggtcgacctgcagccaagcttaattagctgagcttggactcctgttgatagatccagtaatgacctcagaactccatctggatttgttcagaacgctcggttgccgccgggcgttttttattggtgagaatccaagctagcttggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggggtaatgactctctagcttgaggcatcaaataaaacgaaaggctcagtcgaaagactgggcctttcgttttatctgttgtttgtcggtgaacgctctcctgagtaggacaaatccgccctctagagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcac

SEQ ID NO: 346 - DNA, 40 bp, Artificial Sequence
  Primer: F97Dforward
caccccttcttcaatgacgacaccttcgactatgacatcg

SEQ ID NO: 347 - DNA, 40 bp, Artificial Sequence
  Primer: F97Dreverse
cgatgtcatagtcgaaggtgtcgtcattgaagaaggggtg

SEQ ID NO: 348 - DNA, 42 bp, Artificial Sequence
  Primer: F97Eforward
ccaccccttcttcaatgacgagaccttcgactatgacatcgc

SEQ ID NO: 349 - DNA, 42 bp, Artificial Sequence
  Primer: F97Ereverse
gcgatgtcatagtcgaaggtctcgtcattgaagaaggggtgg

SEQ ID NO: 350 - DNA, 39 bp, Artificial Sequence
  Primer: F97Aforward
caccccttcttcaatgacgccaccttcgactatgacatc

SEQ ID NO: 351 - DNA, 39 bp, Artificial Sequence
  Primer: F97Areverse
gatgtcatagtcgaaggtggcgtcattgaagaaggggtg

SEQ ID NO: 352 - DNA, 39 bp, Artificial Sequence
  Primer: F97Wforward
caccccttcttcaatgactggaccttcgactatgacatc

SEQ ID NO: 353 - DNA, 39 bp, Artificial Sequence
  Primer: F97Wreverse
gatgtcatagtcgaaggtccagtcattgaagaaggggtg

SEQ ID NO: 354 - DNA, 27 bp, Artificial Sequence
  Primer: Y146Nforward
ggacacacccagaacggaggcactggc

SEQ ID NO: 355 - DNA, 27 bp, Artificial Sequence
  Primer: Y146Nreverse
gccagtgcctccgttctgggtgtgtcc

SEQ ID NO: 356 - DNA, 27 bp, Artificial Sequence
  Primer: Y146Dforward
ggacacacccaggacggaggcactggc

SEQ ID NO: 357 - DNA, 27 bp, Artificial Sequence
  Primer: Y146Dreverse
gccagtgcctccgtcctgggtgtgtcc

SEQ ID NO: 358 - DNA, 29 bp, Artificial Sequence
  Primer: Y146Eforward
gggacacacccaggagggaggcactggcg

SEQ ID NO: 359 - DNA, 29 bp, Artificial Sequence
  Primer: Y146Ereverse
cgccagtgcctccctcctgggtgtgtccc

SEQ ID NO: 360 - DNA, 29 bp, Artificial Sequence
  Primer: Y146Aforward
gggacacacccaggccggaggcactggcg

SEQ ID NO: 361 - DNA, 29 bp, Artificial Sequence
  Primer: Y146Areverse
cgccagtgcctccggcctgggtgtgtccc

SEQ ID NO: 362 - DNA, 29 bp, Artificial Sequence
  Primer: Y146Wforward
gggacacacccagtggggaggcactggcg

SEQ ID NO: 363 - DNA, 29 bp, Artificial Sequence
  Primer: Y146Wreverse
cgccagtgcctccccactgggtgtgtccc

SEQ ID NO: 364 - DNA, 31 bp, Artificial Sequence
  Primer: Y146Rforward
ggggacacacccagaggggaggcactggcgc

SEQ ID NO: 365 - DNA, 31 bp, Artificial Sequence
  Primer: Y146Rreverse
gcgccagtgcctcccctctgggtgtgtcccc

SEQ ID NO: 366 - DNA, 25 bp, Artificial Sequence
  Primer: Q192Rforward
tggactcctgccggggtgattccgg

SEQ ID NO: 367 - DNA, 25 bp, Artificial Sequence
  Primer: Q192Rreverse
ccggaatcaccccggcaggagtcca

SEQ ID NO: 368 - DNA, 29 bp, Artificial Sequence
  Primer: K224Aforward
cgctcagaggaacgcgccaggcgtgtaca

SEQ ID NO: 369 - DNA, 29 bp, Homo sapiens
  Primer: K224Areverse
tgtacacgcctggcgcgttcctctgagcg

SEQ ID NO: 370 - DNA, 37 bp, Artificial Sequence
  Primer: K224Fforward
gctgcgctcagaggaacttcccaggcgtgtacacaag

SEQ ID NO: 371 - DNA, 37 bp, Artificial Sequence
  Primer: K224Freverse
cttgtgtacacgcctgggaagttcctctgagcgcagc

SEQ ID NO: 372 - DNA, 1575 bp, Homo sapiens
agaaccgcgacctccgcaaccttgagcggcatccgtggagtgcgcctgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgt

SEQ ID NO: 373 - protein, 333 aa, Homo sapiens [sequence omitted]

SEQ ID NO: 374 - DNA, 1342 bp, Homo sapiens
cggctgtaatctcagaggcttgtttgctgagggtgcctgcgcacgtgcgacggctgctggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttcctgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagttt

SEQ ID NO: 375 - protein, 334 aa, Homo sapiens
MNLSLVLAAFCLGIASAVPKFDQNLDTKWYQWKATHRRLYGANEEGWRRAVWEKNMKMIELHNGEYSQGKHGFTMAMNAFGDMTNEEFRQMMGCFRNQKFRKGKVFREPLFLDLPKSVDWRKKGYVTPVKNQKQCGSCWAFSATGALEGQMFRKTGKLVSLSEQNLVDCSRPQGNQGCNGGFMARAFQYVKENGGLDSEESYPYVAVDEICKYRPENSVANDTGFTVVAPGKEKALMKAVATVGPISVAMDAGHSSFQFYKSGIYFEPDCSSKNLDHGVLVVGYGFEGANSNNSKYWLVKNSWGPEWGSNGYVKIAKDKNNHCGIATAASYPNV

SEQ ID NO: 376 - DNA, 1661 bp, Homo sapiens
attcggcacgagccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttggttctctcctcccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttcaatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagttta

SEQ ID NO: 377 - protein, 329 aa, Homo sapiens
MWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 378 - DNA, 1255 bp, Homo sapiens
ctaaagatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgacgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgactctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatgggagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaatagaaaatatagtttgaggccgggcactgtctggctcacgcctgtaatcccagtacttgggaggccaaggaggcatatcaacttgaggccaggagttaaagagcagcctggctaactgtgaaaccctctctact

SEQ ID NO: 379 - protein, 331 aa, Homo sapiens
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVTLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 380 - DNA, 1517 bp, Homo sapiens
gaattccgggtctgttgggtccgggccgccggcttcgccctcgccatggcgccctggctgcagctcctgtcgctgctggggctgctcccgggcgcagtggccgcccccgcccagccccgagccgccagctttcaggcctgggggccgccgtccccggagctgctggcgcccacccgcttcgcgctggagatgttcaaccgcggccgggctgcggggacgcgggccgtgctgggccttgtgcgcggccgcgtccgccgggcgggtcaggggtcgctgtactccctggaggccaccctggaggagccaccctgcaacgaccccatggtgtgccggctccccgtgtccaagaaaaccctgctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggacttgcctgtgaagatggcttcaatcttcaagaactttgtcattacctataaccggacatatgagtcaaaggaagaagcccggtggcgcctgtccgtctttgtcaataacatggtgcgagcacagaagatccaggccctggaccgtgggacagctcagtatggagtcaccaagttcagtgatctcacagaggaggagttccgcactatctacctgaatactctcctgaggaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgtgggtccggggcctgtggcgtgaacaccatggccagctcggcggtggtggactgaagaggggccccgaattc

SEQ ID NO: 381 - protein, 484 aa, Homo sapiens [sequence omitted]

SEQ ID NO: 382 - DNA, 2002 bp, Homo sapiens
aattccgcggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagccttccgagtagtggatctaggatctggcttccaacatgtggcagctctgggcctccctctgctgcctgctggtgttggccaatgcccggagcaggccctctttccatcccgtgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccgcatctgcatccacaccaatgcgcacgtcagcgtggaggtgtcggcggaggacctgctcacctgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgcggaatcgaatcagaagtggtggctggaattccacgcaccgatcagtactgggaaaagatctaatctgccgtgggcctgtcgtgccagtcctgggggcgagatcggggtagaaagtcattttattctttaagttcacgtaagatacaagtttcaggcagggtctgaaggactggattggccaaagtcctccaaggagaccaagtcctggctacatcccagcctgtggttacagtgcagacaggccatgtgagccaccgctgccagcacagagcgtccttccccctgtagactagtgccgtgggagtacctgctgcccagctgctgtggccccctccgtgatccatccatctccagggagcaagacagagacgcaggatggaaagcggagttcctaacaggatgaaagttcccccatcagttcccccagtacctccaagcaagtagctttccacatttgtcacagaaatcagaggagagatggtgttgggagccctttggagaacgccagtctccaggtccccctgcatctatcgagtttgcaatgtcacaacctctctgatcttgtgctcagcatgattctttaatagaagttttatttttcgtgcactctgctaatcatgtgggtgagccagtggaacagcgggagcctgtgctggtttgcagattgcctcctaatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaaggtttctccaacttg

SEQ ID NO: 383 - protein, 339 aa, Homo sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 384 - DNA, 1292 bp, Carica papaya
atccattcccacttaagaagtaaaaagatatagctagtgtcacaatggctatgataccttcaatttcaaagttgctttttgttgcaatatgtctttttgtttatatgggtttgtcatttggtgatttttctattgtgggttattctcaaaatgacttgacatccactgaaagacttattcagctatttgaatcgtggatgttgaagcacaataagatttataagaatattgatgaaaaaatctacagatttgaaatttttaaagataatcttaaatatattgatgagacaaataagaaaaataacagttattggcttggattaaatgtgtttgctgatatgagcaatgatgaattcaaagaaaagtatactggttctattgctggaaattatacaacaaccgaactatcatacgaagaagtgcttaatgatggtgatgtaaatatcccggagtatgtcgattggagacaaaaaggagctgtcactcctgtaaaaaatcagggttcttgtggtagttgttgggcattctcagctgttgtaactatagagggaataattaagattagaactgggaacttaaatgaatactcagagcaagaactgcttgactgcgacagacgtagctacgggtgcaatggaggttacccttggagtgcacttcaattagtggctcaatatggtattcactacagaaatacttacccatatgagggagtgcaacgttattgtcgctcaagggagaaaggtccttatgcagccaaaaccgatggggttcgacaagtgcaaccatataatgaaggggctctcttatattcaattgcaaaccaacctgtgagcgttgtccttgaagctgctggaaaagatttccaattatatagagggggaatatttgtggggccatgcggaaacaaagtagatcatgcagtcgcagcagttgggtatggaccaaattacatactcataaagaattcatggggtacaggatggggtgaaaatggatatataagaatcaaaagaggcactggaaactcctatggagtatgtggactttatacaagctcattctatcctgttaaaaactgatgagatcacggctttcataaaatcccttatatatatatatatatatagaacttgtatactcatcgtgtgttgaaataataaatgagaggattaataatttgtgtaatcctatatatcacagtttgttgtgacaaacttttgcatcgcttgttatattatttgtaataatgtttgttttgattgaataaacttttacatatacttttatgc

SEQ ID NO: 385 - protein, 345 aa, Carica papaya
MAMIPSISKLLFVAICLFVYMGLSFGDFSIVGYSQNDLTSTERLIQLFESWMLKHNKIYKNIDEKIYRFEIFKDNLKYIDETNKKNNSYWLGLNVFADMSNDEFKEKYTGSIAGNYTTTELSYEEVLNDGDVNIPEYVDWRQKGAVTPVKNQGSCGSCWAFSAVVTIEGIIKIRTGNLNEYSEQELLDCDRRSYGCNGGYPWSALQLVAQYGIHYRNTYPYEGVQRYCRSREKGPYAAKTDGVRQVQPYNEGALLYSIANQPVSVVLEAAGKDFQLYRGGIFVGPCGNKVDHAVAAVGYGPNYILIKNSWGTGWGENGYIRIKRGTGNSYGVCGLYTSSFYPVKN

SEQ ID NO: 386 - DNA, 1845 bp, Trypanosoma cruzi
atgtctggctgggcgcgtgcgctgttgctcgcggccgtcctggtcgtcatggcgtgcctcgtccccgcggcgacggcgagcctgcatgcggaggagacgctgacgtcgcaattcgcagaattcaagcagaagcatggcagggtgtacgagagcgccgcggaggaggcgttccgcctgagcgtgttcagggagaacctgtttcttgcgaggctgcacgccgcggcaaacccacacgcgaccttcggcgtcacgcccttctcggacctcacgcgcgaggaattccggtcccgctaccacaacggcgcggcgcactttgcggcggcgcaggagcgcgcgagagtgccggtgaaggtggaggtagttggcgcgcccgcggcagtggattggcgtgcgagaggcgccgtgacagccgtcaaggaccagggccaatgcggttcgtgctgggccttctccgccattggcaacgttgagtgccagtggtttcttgccggccacccgctgacgaacctgtcggagcagatgctcgtgtcgtgcgacaaaacggactctggctgcagtggtggcctgatgaacaacgcctttgagtggattgtgcaggagaataacggcgccgtgtacacggaggacagctacccttatgcgtcgggcgaggggatatcgccgccgtgcacgacgtcaggccacacggtgggtgccacgattaccggtcacgttgaattacctcaggacgaggcccaaatagccgcatggcttgcagtcaatggcccggttgccgttgccgtcgacgccagcagctggatgacctacacgggcggcgttatgacgagctgcgtctccgagcagctggatcacggcgttcttctcgtcggctacaatgacagcgccgcagtgccgtactggatcatcaagaactcgtggaccacgcagtggggcgaggaaggctacatccgcattgcaaagggctcgaaccagtgccttgtcaaggaggaggcgagctccgcggtggtcggtggtcccggacccactcccgagccaaccaccacgacaaccacaagtgccccaggaccgtccccatcgtactttgtgcagatgtcctgcactgacgctgcgtgcattgtcgggtgcgagaacgtgacgttaccgaccggtcagtgtctcctgaccaccagcggcgtctctgccattgtcacgtgcggtgctgagactctcacagaagaagtcttccttacgagtacgcactgcagcggcccatcggtgaggtcctctgttcctctcaacaaatgcaaccggcttttaagaggctccgttgagttcttctgcggctccagctccagtggccgactggccgacgtggacaggcagcgtcgccatcagccataccacagccgtcatcgccgcctctgagggcactctttgtttctgatgctgccttttctctcattttacttttttattattattgagcgagcgtcggtgctgcggcacactgggcaaataagtcccagtggagtggattgtttattgatttgctccatgtatgtgttttcttttttgtgcacaactgcaaatatgtgtccgcgatcgacgtctcagccacgcgtgtgttttttctattatatgcttctgttgagcgcccgagcattccccactgtggctgaacccaccgccgtccccgactgtcacccgaccatgcggggcggggtggcgtggcaacgctcctttgccgcggcgtgcacatacacgcgcgcatgcttcttctctccacgtcaacgccgacaccaccacagtctgaaggtgacgctgttgaaggcacacaaggaaggaaacacacccacacaagcagta

SEQ ID NO: 387 - protein, 467 aa, Trypanosoma cruzi
MSGWARALLLAAVLVVMACLVPAATASLHAEETLTSQFAEFKQKHGRVYESAAEEAFRLSVFRENLFLARLHAAANPHATFGVTPFSDLTREEFRSRYHNGAAHFAAAQERARVPVKVEVVGAPAAVDWRARGAVTAVKDQGQCGSCWAFSAIGNVECQWFLAGHPLTNLSEQMLVSCDKTDSGCSGGLMNNAFEWIVQENNGAVYTEDSYPYASGEGISPPCTTSGHTVGATITGHVELPQDEAQIAAWLAVNGPVAVAVDASSWMTYTGGVMTSCVSEQLDHGVLLVGYNDSAAVPYWIIKNSWTTQWGEEGYIRIAKGSNQCLVKEEASSAVVGGPGPTPEPTTTTTTSAPGPSPSYFVQMSCTDAACIVGCENVTLPTGQCLLTTSGVSAIVTCGAETLTEEVFLTSTHCSGPSVRSSVPLNKCNRLLRGSVEFFCGSSSSGRLADVDRQRRHQPYHSRHRRL

SEQ ID NO: 388 - protein, 4 aa, Artificial Sequence
  Protease cleavage site
LPSR

SEQ ID NO: 389 - protein, 4 aa, Artificial Sequence
  Protease cleavage site
SLLR

SEQ ID NO: 390 - protein, 4 aa, Artificial Sequence
  Protease cleavage site
HRGR

SEQ ID NO: 391 - protein, 4 aa, Artificial Sequence
  Protease cleavage site
GATR

SEQ ID NO: 392 - protein, 4 aa, Artificial Sequence
  Protease cleavage site
SLGR

SEQ ID NO: 393 - protein, 4 aa, Artificial Sequence
  Protease cleavage site
VFAK

SEQ ID NO: 394 - protein, 4 aa, Artificial Sequence
  Protease cleavage site
REFK

SEQ ID NO: 395 - protein, 4 aa, Artificial Sequence
  Protease cleavage site
GLAR

SEQ ID NO: 396 - protein, 4 aa, Artificial Sequence
  Protease cleavage site
RLGR

SEQ ID NO: 397 - protein, 4 aa, Artificial Sequence
  Protease cleavage site
AEGK

SEQ ID NO: 398 - protein, 4 aa, Artificial Sequence
  Protease cleavage site
QHAR

SEQ ID NO: 399 - protein, 4 aa, Artificial Sequence
  Protease cleavage site
LGLA

SEQ ID NO: 400 - protein, 4 aa, Artificial Sequence
  Protease cleavage site
LSVV

SEQ ID NO: 401 - protein, 4 aa, Artificial Sequence
  Protease cleavage site
RQAR

SEQ ID NO: 402 - protein, 4 aa, Artificial Sequence
  Protease cleavage site
PRFK

SEQ ID NO: 403 - protein, 4 aa, Artificial Sequence
  Protease cleavage site
KQGR

SEQ ID NO: 404 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 405 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCVGDSGGPLSSVEADGRIFQAGVVSWGDGCAQRNKPGVYTRLPLFRDWIKENTGV

SEQ ID NO: 406 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDDTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 407 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDETFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 408 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDATFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 409 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 410 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQNGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 411 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 412 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 413 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQAGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 414 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQWGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 415 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQRGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 416 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQRGGTGALILQKGEIRVINQTTCENLLPQQITPRMMCVGFLSGGVDSCRGDSGGPLSSVEADGRIFQAGVVSWGDGCAQRNKPGVYTRLPLFRDWIKENTGV

SEQ ID NO: 417 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQRGGTGALILQKGEIRVINQTTCENLLPQQITPRMMCVGFLSGGVDSCRGDSGGPLSSVEADGRIFQAGVVSWGDGCAQRNAPGVYTRLPLFRDWIKENTGV

SEQ ID NO: 418 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDWTFDYDIALLELEKPAEYSSMVRPICLPDASHVFPAGKAIWVTGWGHTQRGGTGALILQKGEIRVINQTTCENLLPQQITPRMMCVGFLSGGVDSCRGDSGGPLSSVEADGRIFQAGVVSWGDGCAQRNFPGVYTRLPLFRDWIKENTGV

SEQ ID NO: 419 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPHQITPRMMCVGFLSGGVDSCQGDSGGPLSSVEADGRIFQAGVVSWGDGCAQRNKPGVYTRLPLFRDWIKENTGV

SEQ ID NO: 420 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGQGCAQRNKPGVYTRLPLFRDWIKENTGV

SEQ ID NO: 421 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGNGCAQRNKPGVYTRLPLFRDWIKENTGV

SEQ ID NO: 422 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGHGCAQRNKPGVYTRLPLFRDWIKENTGV

SEQ ID NO: 423 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNAFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 424 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNVFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 425 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNFFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 426 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNSFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 427 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNTFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 428 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCLGDSGGPLSSVEADGRIFQAGVVSWGDGCAQRNKPGVYTRLPLFRDWIKENTGV

SEQ ID NO: 429 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCIGDSGGPLSSVEADGRIFQAGVVSWGDGCAQRNKPGVYTRLPLFRDWIKENTGV

SEQ ID NO: 430 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCFGDSGGPLSSVEADGRIFQAGVVSWGDGCAQRNKPGVYTRLPLFRDWIKENTGV

SEQ ID NO: 431 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQFGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 432 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTADYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 433 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTVDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 434 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTSDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 435 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTGDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 436 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSFGDGCAQRNKPGVYTRLPLFRDWIKENTGV

SEQ ID NO: 437 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSYGDGCAQRNKPGVYTRLPLFRDWIKENTGV

SEQ ID NO: 438 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPAQITPRMMCVGFLSGGVDSCQGDSGGPLSSVEADGRIFQAGVVSWGDGCAQRNKPGVYTRLPLFRDWIKENTGV

SEQ ID NO: 439 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPVQITPRMMCVGFLSGGVDSCQGDSGGPLSSVEADGRIFQAGVVSWGDGCAQRNKPGVYTRLPLFRDWIKENTGV

SEQ ID NO: 440 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPFQITPRMMCVGFLSGGVDSCQGDSGGPLSSVEADGRIFQAGVVSWGDGCAQRNKPGVYTRLPLFRDWIKENTGV

SEQ ID NO: 441 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPRQITPRMMCVGFLSGGVDSCQGDSGGPLSSVEADGRIFQAGVVSWGDGCAQRNKPGVYTRLPLFRDWIKENTGV

SEQ ID NO: 442 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPKQITPRMMCVGFLSGGVDSCQGDSGGPLSSVEADGRIFQAGVVSWGDGCAQRNKPGVYTRLPLFRDWIKENTGV

SEQ ID NO: 443 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGAGCAQRNKPGVYTRLPLFRDWIKENTGV

SEQ ID NO: 444 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGVGCAQRNKPGVYTRLPLFRDWIKENTGV

SEQ ID NO: 445 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCEGDSGGPLSSVEADGRIFQAGVVSWGDGCAQRNKPGVYTRLPLFRDWIKENTGV

SEQ ID NO: 446 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTWDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 447 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTYDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 448 - protein, 855 aa, Homo Sapiens [sequence omitted]

SEQ ID NO: 449 - protein, 855 aa, Mus musculus
MGSNRGRKAGGGSQDFGAGLKYNSRLENMNGFEEGVEFLPANNAKKVEKRGPRRWVVLVAVLFSFLLLSLMAGLLVWHFHYRNVRVQKVFNGHLRITNEIFLDAYENSTSTEFISLASQVKEALKLLYNEVPVLGPYHKKSAVTAFSEGSVIAYYWSEFSIPPHLAEEVDRAMAVERVVTLPPRARALKSFVLTSVVAFPIDPRMLQRTQDNSCSFALHAHGAAVTRFTTPGFPNSPYPAHARCQWVLRGDADSVLSLTFRSFDVAPCDEHGSDLVTVYDSLSPMEPHAVVRLCGTFSPSYNLTFLSSQNVFLVTLITNTDRRHPGFEATFFQLPKMSSCGGFLSDTQGTFSSPYYPGHYPPNINCTWNIKVPNNRNVKVRFKLFYLVDPNVPVGSCTKDYVEINGEKYCGERSQFVVSSNSSKITVHFHSDHSYTDTGFLAEYLSYDSNDPCPGMFMCKTGRCIRKELRCDGWADCPDYSDERYCRCNATHQFTCKNQFCKPLFWVCDSVNDCGDGSDEEGCSCPAGSFKCSNGKCLPQSQKCNGKDNCGDGSDEASCDSVNVVSCTKYTYRCQNGLCLSKGNPECDGKTDCSDGSDEKNCDCGLRSFTKQARVVGGTNADEGEWPWQVSLHALGQGHLCGASLISPDWLVSAAHCFQDDKNFKYSDYTMWTAFLGLLDQSKRSASGVQELKLKRIITHPSFNDFTFDYDIALLELEKSVEYSTVVRPICLPDATHVFPAGKAIWVTGWGHTKEGGTGALILQKGEIRVINQTTCEDLMPQQITPRMMCVGFLSGGVDSCQGDSGGPLSSAEKDGRMFQAGVVSWGEGCAQRNKPGVYTRLPVVRDWIKEHTGV

SEQ ID NO: 450 - protein, 855 aa, Rattus norvegicus
MGNNRGRKAGGGSQDFGAGLKYNSRLENMNGFEEGVEFLPVNNAKQVEKRGPRRWVVMVAVVFSFLLLSLMAGLLVWHFHYRNVRIQKVFNGHLRITNENFLDAYENSTSTEFISLASQVKEALKLMYSEVPVLGPYHKKSTVTAFSEGSVIAYYWSEFSIPPHLEEEVDRAMAVERVVTLPPRARALKSFVLTSVVAFPIDPRMLQRTQDNSCSFALHARGRTVTRFTTPGFPNSPYPAHARCQWVLRGDADSVLSLTFRSFDVAPCDGHDSDLVTVYDSLSPMEPHAVVRLCGTFSPSYNLTFLSSQNVFLVTLITNTDRRHPGFEATFFQLPKMSSCGGLLSEAQGTFSSPYYPGHYPPNINCTWNIKVPNNRNVKVRFKLFYLVDPNIPVGSCTKDYVEINGEKFCGERSQFVVSSNSSKITVHFHSDHSYTDTGFLAEYLSYDSNDPCPGMFMCKTGRCIRKDLRCDGWADCPDYSDERHCRCNATHQFMCKNQFCKPLFWVCDSVNDCGDGSDEEGCSCPAGSFKCSNGKCLPQSQQCNGKDDCGDGSDEASCDNVNAVSCTKYTYRCQNGLCLNKGNPECDGKKDCSDGSDEKNCDCGLRSFTKQARVVGGTNADEGEWPWQVSLHALGQGHLCGASLISPDWLVSAAHCFQDETIFKYSDHTMWTAFLGLLDQSKRSASGVQEHKLKRIITHPSFNDFTFDYDIALLELEKPAEYSTVVRPICLPDNTHVFPAGKAIWVTGWGHTKEGGTGALILQKGEIRVINQTTCEELLPQQITPRMMCVGFLSGGVDSCQGDSGGPLSSVEKDGRIFQAGVVSWGEGCAQRNKPGVYTRIPEVRDWIKEQTGV

SEQ ID NO: 451 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcacatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 452 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggacaaggctgcgctcagaggaacaagccaggcgtgtacacaaggctccctctgtttcgggactggatcaaagagaacactggggta

SEQ ID NO: 453 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggaaacggctgcgctcagaggaacaagccaggcgtgtacacaaggctccctctgtttcgggactggatcaaagagaacactggggta

SEQ ID NO: 454 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggacacggctgcgctcagaggaacaagccaggcgtgtacacaaggctccctctgtttcgggactggatcaaagagaacactggggta

SEQ ID NO: 455 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgccttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 456 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgtcttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 457 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatttcttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 458 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaattccttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 459 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaataccttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 460 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgcctgggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 461 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgcatcggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 462 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgcttcggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 463 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtttggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 464 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccgccgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 465 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccgtcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 466 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcacctcagactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 467 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccggcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 468 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagcttcggagacggctgcgctcagaggaacaagccaggcgtgtacacaaggctccctctgtttcgggactggatcaaagagaacactggggta

SEQ ID NO: 469 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctacggagacggctgcgctcagaggaacaagccaggcgtgtacacaaggctccctctgtttcgggactggatcaaagagaacactggggta

SEQ ID NO: 470 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccggcgcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 471 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccggtgcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 472 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgttccagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 473 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcgacagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 474 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgaagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 475 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagctggctgcgctcagaggaacaagccaggcgtgtacacaaggctccctctgtttcgggactggatcaaagagaacactggggta

SEQ ID NO: 476 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagtaggctgcgctcagaggaacaagccaggcgtgtacacaaggctccctctgtttcgggactggatcaaagagaacactggggta

SEQ ID NO: 477 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgcgaaggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 478 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcacctgggactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 479 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcacctatgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 480 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccaggacggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacttcccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 481 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgcgtcggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 482 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacgacaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 483 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacgagaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 484 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacgccaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 485 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 486 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccagaacggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 487 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccaggacggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 488 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccaggagggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 489 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccaggccggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 490 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtggggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 491 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccagaggggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 492 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccagaggggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccggggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 493 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccagaggggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccggggtgattccgggggacccctgtccagcgtggaggcggatgggcggatcttccaggccggtgtggtgagctggggagacggctgcgctcagaggaacgcgccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 494 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgactggaccttcgactatgacatcgcgctgctggagctggagaaaccggcagagtacagctccatggtgcggcccatctgcctgccggacgcctcccatgtcttccctgccggcaaggccatctgggtcacgggctggggacacacccagaggggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccggggtgattccgggggacccctgtccagcgtggaggcggatgggcggatcttccaggccggtgtggtgagctggggagacggctgcgctcagaggaacttcccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 495 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcacatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 496 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggacaaggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 497 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggaaacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 498 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggacacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 499 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgccttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 500 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgtcttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 501 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatttcttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 502 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaattccttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 503 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaataccttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 504 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgcctgggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 505 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgcatcggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 506 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgcttcggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 507 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtttggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 508 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccgccgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 509 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccgtcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 510 - DNA, 3149 bp, Homo Sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcacctcagactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 511 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccggcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 512 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagcttcggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 513 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctacggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 514 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccggcgcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 515 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccggtgcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 516 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgttccagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 517 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcgacagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 518 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgaagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 519 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagctggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 520 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagtaggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 521 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgcgaaggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 522 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcacctgggactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 523 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcacctatgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 524 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPLQITPRMMCVGFLSGGVDSCQGDSGGPLSSVEADGRIFQAGVVSWGDGCAQRNKPGVYTRLPLFRDWIKENTGV

SEQ ID NO: 525 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPYQITPRMMCVGFLSGGVDSCQGDSGGPLSSVEADGRIFQAGVVSWGDGCAQRNKPGVYTRLPLFRDWIKENTGV

SEQ ID NO: 526 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPREMCVGFLSGGVDSCQGDSGGPLSSVEADGRIFQAGVVSWGDGCAQRNKPGVYTRLPLFRDWIKENTGV

SEQ ID NO: 527 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCKGDSGGPLSSVEADGRIFQAGVVSWGDGCAQRNKPGVYTRLPLFRDWIKENTGV

SEQ ID NO: 528 - protein, 241 aa, Homo sapiens
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCYGDSGGPLSSVEADGRIFQAGVVSWGDGCAQRNKPGVYTRLPLFRDWIKENTGV

SEQ ID NO: 529 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPLQITPRMMCVGFLSGGVDSCQGDSGGPLSSVEADGRIFQAGVVSWGDGCAQRNKPGVYTRLPLFRDWIKENTGV

SEQ ID NO: 530 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPYQITPRMMCVGFLSGGVDSCQGDSGGPLSSVEADGRIFQAGVVSWGDGCAQRNKPGVYTRLPLFRDWIKENTGV

SEQ ID NO: 531 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPREMCVGFLSGGVDSCQGDSGGPLSSVEADGRIFQAGVVSWGDGCAQRNKPGVYTRLPLFRDWIKENTGV

SEQ ID NO: 532 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCKGDSGGPLSSVEADGRIFQAGVVSWGDGCAQRNKPGVYTRLPLFRDWIKENTGV

SEQ ID NO: 533 - protein, 855 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCYGDSGGPLSSVEADGRIFQAGVVSWGDGCAQRNKPGVYTRLPLFRDWIKENTGV

SEQ ID NO: 534 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgttgcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 535 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgtatcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 536 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcgagatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 537 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgcaagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 538 - DNA, 723 bp, Homo sapiens
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgctatggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 539 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgttgcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 540 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgtatcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 541 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcgagatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 542 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgcaagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 543 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgctatggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 544 - protein, 99 aa, Unknown [sequence omitted]

SEQ ID NO: 545 - protein, 124 aa, Unknown
  Rous sarcoma virus retropepsin
LAMTMEHKDRPLVRVILTNTGSHPVKQRSVYITALLDSGADITIISEEDWPTDWPVMEAANPQIHGIGGGIPMRKSRDMIELGVINRDGSLERPLLLFPAVAMVRGSILGRDCLQGLGLRLTNL

SEQ ID NO: 546 - DNA, 1801 bp, Homo sapiens
gcaaggcatagagacaacatagagctaagtaaagccagtggaaatgaagagtcttccaatcctactgttgctgtgcgtggcagtttgctcagcctatccattggatggagctgcaaggggtgaggacaccagcatgaaccttgttcagaaatatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtgatgcgcaagcccaggtgtggagttcctgatgttggtcacttcagaacctttcctggcatcccgaagtggaggaaaacccaccttacatacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagagaacatggagacttttacccttttgatggacctggaaatgttttggcccatgcctatgcccctgggccagggattaatggagatgcccactttgatgatgatgaacaatggacaaaggatacaacagggaccaatttatttctcgttgctgctcatgaaattggccactccctgggtctctttcactcagccaacactgaagctttgatgtacccactctatcactcactcacagacctgactcggttccgcctgtctcaagatgatataaatggcattcagtccctctatggacctccccctgactcccctgagacccccctggtacccacggaacctgtccctccagaacctgggacgccagccaactgtgatcctgctttgtcctttgatgctgtcagcactctgaggggagaaatcctgatctttaaagacaggcacttttggcgcaaatccctcaggaagcttgaacctgaattgcatttgatctcttcattttggccatctcttccttcaggcgtggatgccgcatatgaagttactagcaaggacctcgttttcatttttaaaggaaatcaattctgggccatcagaggaaatgaggtacgagctggatacccaagaggcatccacaccctaggtttccctccaaccgtgaggaaaatcgatgcagccatttctgataaggaaaagaacaaaacatatttctttgtagaggacaaatactggagatttgatgagaagagaaattccatggagccaggctttcccaagcaaatagctgaagactttccagggattgactcaaagattgatgctgtttttgaagaatttgggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctgtgtagactatttgcttatttaataaagacgatttgtcagttgtttt

SEQ ID NO: 547 - protein, 477 aa, Homo sapiens
MKSLPILLLLCVAVCSAYPLDGAARGEDTSMNLVQKYLENYYDLKKDVKQFVRRKDSGPVVKKIREMQKFLGLEVTGKLDSDTLEVMRKPRCGVPDVGHFRTFPGIPKWRKTHLTYRIVNYTPDLPKDAVDSAVEKALKVWEEVTPLTFSRLYEGEADIMISFAVREHGDFYPFDGPGNVLAHAYAPGPGINGDAHFDDDEQWTKDTTGTNLFLVAAHEIGHSLGLFHSANTEALMYPLYHSLTDLTRFRLSQDDINGIQSLYGPPPDSPETPLVPTEPVPPEPGTPANCDPALSFDAVSTLRGEILIFKDRHFWRKSLRKLEPELHLISSFWPSLPSGVDAAYEVTSKDLVFIFKGNQFWAIRGNEVRAGYPRGIHTLGFPPTVRKIDAAISDKEKNKTYFFVEDKYWRFDEKRNSMEPGFPKQIAEDFPGIDSKIDAVFEEFGFFYFFTGSSQLEFDPNAKKVTHTLKSNSWLNC

SEQ ID NO: 548 - DNA, 4111 bp, Homo sapiens
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagatttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctcttttgtgtctcctagtagcttcctactcaactatttataatctcattaattaaaaagttataattttagataaaaattctagtcaaatttttacagatattatctcactaattttcagacttttgccaaagtgtgcacaatggctttttgttaataaagaacagattagttttgaagaaggcaaaaatttcagttttctgaagacagcatgttattttaacaatcaagtatacatattaaaaattgtgagcaatctcaaaaaaaaaaaaaaa

SEQ ID NO: 549 - protein, 819 aa, Homo sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 550 - DNA, 3927 bp, Homo sapiens
gcggcggcaggcctagcagcacgggaaccgtcccccgcgcgcatgcgcgcgcccctgaagcgcctgggggacgggtatgggcgggaggtaggggcgcggctccgcgtgccagttgggtgcccgcgcgtcacgtggtgaggaaggaggcggaggtctgagtttcgaaggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagag

SEQ ID NO: 551 - protein, 748 aa, Homo sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 552 - protein, 241 aa, Homo sapiens
  Mutant MT-SP1 sequence; protease domain
  CB0252
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNNPGVYTRLPLFRDWIKENTGV

SEQ ID NO: 553 - protein, 241 aa, Homo sapiens
  Mutant MT-SP1 sequence; protease domain
  CB0486
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQDITPRMMCVGFLSGGVDSCQGDSGGPLSSVEADGRIFQAGVVSWGDGCAQRNRPGVYTRLPLFRDWIKENTGV

SEQ ID NO: 554 - protein, 241 aa, Homo sapiens
  Mutant MT-SP1 sequence; protease domain
  CB0351
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 555 - protein, 242 aa, Homo sapiens
  Mutant MT-SP1 sequence; protease domain
  CB0422
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYEGGTGALILQKGEIRVINQTTCENLLPQDITPRMMCVGFLSGGVDSCQGDSGGPLSSVEADGRIFQAGVVSWGDGCAQRNNPGVYTRLPLFRDWIKENTGV

SEQ ID NO: 556 - protein, 241 aa, Homo sapiens
  Mutant MT-SP1 sequence; protease domain
  CB0489
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTLALILQKGEIRVINQTTCENLLPQDITPRMMCVGFLSGGVDSCQGDSGGPLSSVEADGRIFQAGVVSWGDGCAQRNLPGVYTRLPLFRDWIKENTGV

SEQ ID NO: 557 - protein, 241 aa, Homo sapiens
  Mutant MT-SP1 sequence; protease domain
  CB0464
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPEFITPRMMCVGFLSGGVDSCQGDSGGPLSSVEADGRIFQAGVVSWGDGCAQRNKPGVYTRLPLFRDWIKENTGV

SEQ ID NO: 558 - protein, 241 aa, Homo sapiens
  Mutant MT-SP1 sequence; protease domain
  CB0490
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTLALILQKGEIRVINQTTCENLLPQDITPRMMCVGFLSGGVDSCQGDSGGPLSSVEADGRIFQAGVVSWGDGCAQRNRPGVYTRLPLFRDWIKENTGV

SEQ ID NO: 559 - protein, 241 aa, Homo sapiens
  Mutant MT-SP1 sequence; protease domain
  CB0487
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTLALILQKGEIRVINQTTCENLLPQDITPRMMCVGFLSGGVDSCQGDSGGPLSSVEADGRIFQAGVVSWGDGCAQRNNPGVYTRLPLFRDWIKENTGV

SEQ ID NO: 560 - protein, 241 aa, Homo sapiens
  Mutant MT-SP1 sequence; protease domain
  CB0268
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCADRNKPGVYTRLPLFRDWIKENTGV

SEQ ID NO: 561 - protein, 241 aa, Homo sapiens
  Mutant MT-SP1 sequence; protease domain
  CB0251
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNRPGVYTRLPLFRDWIKENTGV

SEQ ID NO: 562 - protein, 241 aa, Homo sapiens
  Mutant MT-SP1 sequence; protease domain
  CB0377
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQDITPRMMCVGFLSGGVDSCQGDSGGPLSSVEADGRIFQAGVVSWGDGCAQRNNPGVYTRLPLFRDWIKENTGV

SEQ ID NO: 563 - protein, 241 aa, Homo sapiens
  Mutant MT-SP1 sequence; protease domain
  CB0244
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNRPGVYTRLPLFRDWIKENTGV

SEQ ID NO: 564 - protein, 241 aa, Homo sapiens
  Mutant MT-SP1 sequence; protease domain
  CB0488
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTLALILQKGEIRVINQTTCENLLPQDITPRMMCVGFLSGGVDSCQGDSGGPLSSVEADGRIFQAGVVSWGDGCAQRNFPGVYTRLPLFRDWIKENTGV

SEQ ID NO: 565 - protein, 241 aa, Homo sapiens
  Mutant MT-SP1 sequence; protease domain
  CB0373
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQDITPRMMCVGFLSGGVDSCQGDSGGPLSSVEADGRIFQAGVVSWGDGCAQRNRPGVYTRLPLFRDWIKENTGV

SEQ ID NO: 566 - protein, 241 aa, Homo sapiens
  Mutant MT-SP1 sequence; protease domain
  CB0232
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNLPGVYTRLPLFRDWIKENTGV

SEQ ID NO: 567 - protein, 241 aa, Homo sapiens
  Mutant MT-SP1 sequence; protease domain
  CB0082
VVGGTDADEGEWPWQVSLHALGQGHICGASLISPNWLVSAAHCYIDDWGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 568 - protein, 241 aa, Homo sapiens
  Mutant MT-SP1 sequence; protease domain
  CB0274
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYEGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 569 - protein, 241 aa, Homo sapiens
  Mutant MT-SP1 sequence; protease domain
  CB0080
VVGGTDADEGEWPWQVSLHALGQGHICGASLISPNWLVSAAHCYIDDDGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 570 - protein, 241 aa, Homo sapiens
  Mutant MT-SP1 sequence; protease domain
  CB0367
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQDITPRMMCVGFLSGGVDSCQGDSGGPLSSVEADGRIFQAGVVSWGDGCAQRNRPGVYTRLPLFRDWIKENTGV

SEQ ID NO: 571 - protein, 241 aa, Homo sapiens
  Mutant MT-SP1 sequence; protease domain
  CB0383
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQLITPRMMCVGFLSGGVDSCQGDSGGPLSSVEADGRIFQAGVVSWGDGCAQRNLPGVYTRLPLFRDWIKENTGV

SEQ ID NO: 572 - protein, 241 aa, Homo sapiens
  Mutant MT-SP1 sequence; protease domain
  CB0357
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNLPGVYTRLPLFRDWIKENTGV

SEQ ID NO: 573 - protein, 241 aa, Homo sapiens
  Mutant MT-SP1 sequence; protease domain
  CB0387
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQWITPRMMCVGFLSGGVDSCQGDSGGPLSSVEADGRIFQAGVVSWGDGCAQRNLPGVYTRLPLFRDWIKENTGV

SEQ ID NO: 574 - protein, 241 aa, Homo sapiens
  Mutant MT-SP1 sequence; protease domain
  CB0238
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNLPGVYTRLPLFRDWIKENTGV

SEQ ID NO: 575 - protein, 241 aa, Homo sapiens
  Mutant MT-SP1 sequence; protease domain
  CB0458
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAERNRPGVYTRLPLFRDWIKENTGV

SEQ ID NO: 576 - protein, 241 aa, Homo sapiens
  Mutant MT-SP1 sequence; protease domain
  CB0235
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNAPGVYTRLPLFRDWIKENTGV

SEQ ID NO: 577 - protein, 241 aa, Homo sapiens
  Mutant MT-SP1 sequence; protease domain
  CB0381
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQHITPRMMCVGFLSGGVDSCQGDSGGPLSSVEADGRIFQAGVVSWGDGCAQRNLPGVYTRLPLFRDWIKENTGV

SEQ ID NO: 578 - protein, 241 aa, Homo sapiens
  Mutant MT-SP1 sequence; protease domain
  CB0388
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQYITPRMMCVGFLSGGVDSCQGDSGGPLSSVEADGRIFQAGVVSWGDGCAQRNLPGVYTRLPLFRDWIKENTGV

SEQ ID NO: 579 - protein, 241 aa, Homo sapiens
  Mutant MT-SP1 sequence; protease domain
  CB0257
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNYPGVYTRLPLFRDWIKENTGV

SEQ ID NO: 580 - protein, 241 aa, Homo sapiens
  Mutant MT-SP1 sequence; protease domain
  CB0385
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQFITPRMMCVGFLSGGVDSCQGDSGGPLSSVEADGRIFQAGVVSWGDGCAQRNLPGVYTRLPLFRDWIKENTGV

SEQ ID NO: 581 - protein, 241 aa, Homo sapiens
  Mutant MT-SP1 sequence; protease domain
  CB0021
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQEITPRMMCVGFLSGGVDSCQGDSGGPLSSVEADGRIFQAGVVSWGDGCAQRNKPGVYTRLPLFRDWIKENTGV

SEQ ID NO: 582 - protein, 241 aa, Homo sapiens
  Mutant MT-SP1 sequence; protease domain
  CB0020
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQDITPRMMCVGFLSGGVDSCQGDSGGPLSSVEADGRIFQAGVVSWGDGCAQRNKPGVYTRLPLFRDWIKENTGV

SEQ ID NO: 583 - protein, 241 aa, Homo sapiens
  Mutant MT-SP1 sequence; protease domain
  CB0245
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNNPGVYTRLPLFRDWIKENTGV

SEQ ID NO: 584 - protein, 241 aa, Homo sapiens
  Mutant MT-SP1 sequence; protease domain
  CB0451
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCALRNSPGVYTRLPLFRDWIKENTGV

SEQ ID NO: 585 - protein, 241 aa, Homo sapiens
  Mutant MT-SP1 sequence; protease domain
  CB0332
VVGGTDADEGEWPWQVSLHALGQGHECGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNLPGVYTRLPLFRDWIKENTGV

SEQ ID NO: 586 - protein, 241 aa, Homo sapiens
  Mutant MT-SP1 sequence; protease domain
  CB0403
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGFGCAQRNLPGVYTRLPLFRDWIKENTGV

SEQ ID NO: 587 - protein, 241 aa, Homo sapiens
  Mutant MT-SP1 sequence; protease domain
  CB0353
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGVTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 588 - protein, 241 aa, Homo sapiens
  Mutant MT-SP1 sequence; protease domain
  CB0213
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 589 - protein, 241 aa, Homo sapiens
  Mutant MT-SP1 sequence; protease domain
  CB0214
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQAGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 590 - protein, 241 aa, Homo sapiens
  Mutant MT-SP1 sequence; protease domain
  CB0255
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNTPGVYTRLPLFRDWIKENTGV

SEQ ID NO: 591 - protein, 241 aa, Homo sapiens
  Mutant MT-SP1 sequence; protease domain
  CB0423
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNLPGVYTRLPLFRDWIKENTGV

SEQ ID NO: 592 - protein, 241 aa, Homo sapiens; identical to SEQ ID NO: 53
  Mutant MT-SP1 sequence; protease domain
  CB0016

SEQ ID NO: 593 - protein, 241 aa, Homo sapiens
  Mutant MT-SP1 sequence; protease domain
  CB0017
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLNPQQITPRMMCVGFLSGGVDSCQGDSGGPLSSVEADGRIFQAGVVSWGDGCAQRNKPGVYTRLPLFRDWIKENTGV

SEQ ID NO: 594 - protein, 241 aa, Homo sapiens
  Mutant MT-SP1 sequence; protease domain
  CB0413
VVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 595 - protein, 241 aa, Homo sapiens
  Mutant MT-SP1 sequence; protease domain
  CB0412
VVGGTDADEGEWPWQVSLHALGQGHLCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 596 - protein, 241 aa, Homo sapiens
  Mutant MT-SP1 sequence; protease domain
  CB0450
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 597 - protein, 241 aa, Homo sapiens
  Mutant MT-SP1 sequence; protease domain
  CB0409
VVGGTDADEGEWPWQVSLHALGQGHACGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 598 - protein, 241 aa, Homo sapiens
  Mutant MT-SP1 sequence; protease domain
  CB0350
VVGGTDADEGEWPWQVSLHALGQGHECGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 599 - protein, 241 aa, Homo sapiens
  Mutant MT-SP1 sequence; protease domain
  CB0331
VVGGTDADEGEWPWQVSLHALGQGHDCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNLPGVYTRLPLFRDWIKENTGV

SEQ ID NO: 600 - protein, 241 aa, Homo sapiens
  Mutant MT-SP1 sequence; protease domain
  CB0349
VVGGTDADEGEWPWQVSLHALGQGHDCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 601 - protein, 241 aa, Homo sapiens
  Mutant MT-SP1 sequence; protease domain
  CB0212
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQNGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 602 - protein, 241 aa, Homo sapiens
  Mutant MT-SP1 sequence; protease domain
  CB0421
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQDITPRMMCVGFLSGGVDSCQGDSGGPLSSVEADGRIFQAGVVSWGDGCAQRNFPGVYTRLPLFRDWIKENTGV

SEQ ID NO: 603 - protein, 241 aa, Homo sapiens
  Mutant MT-SP1 sequence; protease domain
  CB0218
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCFGDSGGPLSSVEADGRIFQAGVVSWGDGCAQRNFPGVYTRLPLFRDWIKENTGV

SEQ ID NO: 604 - protein, 241 aa, Homo sapiens
  Mutant MT-SP1 sequence; protease domain
  CB0219
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCAGDSGGPLSSVEADGRIFQAGVVSWGDGCAQRNFPGVYTRLPLFRDWIKENTGV

SEQ ID NO: 605 - protein, 241 aa, Homo sapiens
  Mutant MT-SP1 sequence; protease domain
  CB0216
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCVGDSGGPLSSVEADGRIFQAGVVSWGDGCAQRNFPGVYTRLPLFRDWIKENTGV

SEQ ID NO: 606 - protein, 855 aa, Homo sapiens
  Mutant MT-SP1 sequence; full length
  CB0252
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNNPGVYTRLPLFRDWIKENTGV

SEQ ID NO: 607 - protein, 855 aa, Homo sapiens
  Mutant MT-SP1 sequence; full length
  CB0486
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQDITPRMMCVGFLSGGVDSCQGDSGGPLSSVEADGRIFQAGVVSWGDGCAQRNRPGVYTRLPLFRDWIKENTGV

SEQ ID NO: 608 - protein, 855 aa, Homo sapiens
  Mutant MT-SP1 sequence; full length
  CB0351
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 609 - protein, 855 aa, Homo sapiens
  Mutant MT-SP1 sequence; full length
  CB0422
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQDITPRMMCVGFLSGGVDSCQGDSGGPLSSVEADGRIFQAGVVSWGDGCAQRNNPGVYTRLPLFRDWIKENTGV

SEQ ID NO: 610 - protein, 855 aa, Homo sapiens
  Mutant MT-SP1 sequence; full length
  CB0489
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTLALILQKGEIRVINQTTCENLLPQDITPRMMCVGFLSGGVDSCQGDSGGPLSSVEADGRIFQAGVVSWGDGCAQRNLPGVYTRLPLFRDWIKENTGV

SEQ ID NO: 611 - protein, 855 aa, Homo sapiens
  Mutant MT-SP1 sequence; full length
  CB0464
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPEFITPRMMCVGFLSGGVDSCQGDSGGPLSSVEADGRIFQAGVVSWGDGCAQRNKPGVYTRLPLFRDWIKENTGV

SEQ ID NO: 612 - protein, 855 aa, Homo sapiens
  Mutant MT-SP1 sequence; full length
  CB0490
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTLALILQKGEIRVINQTTCENLLPQDITPRMMCVGFLSGGVDSCQGDSGGPLSSVEADGRIFQAGVVSWGDGCAQRNRPGVYTRLPLFRDWIKENTGV

SEQ ID NO: 613 - protein, 855 aa, Homo sapiens
  Mutant MT-SP1 sequence; full length
  CB0487
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTLALILQKGEIRVINQTTCENLLPQDITPRMMCVGFLSGGVDSCQGDSGGPLSSVEADGRIFQAGVVSWGDGCAQRNNPGVYTRLPLFRDWIKENTGV

SEQ ID NO: 614 - protein, 855 aa, Homo sapiens
  Mutant MT-SP1 sequence; full length
  CB0268
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCADRNKPGVYTRLPLFRDWIKENTGV

SEQ ID NO: 615 - protein, 855 aa, Homo sapiens
  Mutant MT-SP1 sequence; full length
  CB0251
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNRPGVYTRLPLFRDWIKENTGV

SEQ ID NO: 616 - protein, 855 aa, Homo sapiens
  Mutant MT-SP1 sequence; full length
  CB0377
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQDITPRMMCVGFLSGGVDSCQGDSGGPLSSVEADGRIFQAGVVSWGDGCAQRNNPGVYTRLPLFRDWIKENTGV

SEQ ID NO: 617 - protein, 855 aa, Homo sapiens
  Mutant MT-SP1 sequence; full length
  CB0244
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNRPGVYTRLPLFRDWIKENTGV

SEQ ID NO: 618 - protein, 855 aa, Homo sapiens
  Mutant MT-SP1 sequence; full length
  CB0488
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTLALILQKGEIRVINQTTCENLLPQDITPRMMCVGFLSGGVDSCQGDSGGPLSSVEADGRIFQAGVVSWGDGCAQRNFPGVYTRLPLFRDWIKENTGV

SEQ ID NO: 619 - protein, 855 aa, Homo sapiens
  Mutant MT-SP1 sequence; full length
  CB0373
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQDITPRMMCVGFLSGGVDSCQGDSGGPLSSVEADGRIFQAGVVSWGDGCAQRNRPGVYTRLPLFRDWIKENTGV

SEQ ID NO: 620 - protein, 855 aa, Homo sapiens
  Mutant MT-SP1 sequence; full length
  CB0232
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNLPGVYTRLPLFRDWIKENTGV

SEQ ID NO: 621 - protein, 855 aa, Homo sapiens
  Mutant MT-SP1 sequence; full length
  CB0082
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDWGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 622 - protein, 855 aa, Homo sapiens
  Mutant MT-SP1 sequence; full length
  CB0274
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYEGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 623 - protein, 855 aa, Homo sapiens
  Mutant MT-SP1 sequence; full length
  CB0080
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDDGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 624 - protein, 855 aa, Homo sapiens
  Mutant MT-SP1 sequence; full length
  CB0367
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQDITPRMMCVGFLSGGVDSCQGDSGGPLSSVEADGRIFQAGVVSWGDGCAQRNRPGVYTRLPLFRDWIKENTGV

SEQ ID NO: 625 - protein, 855 aa, Homo sapiens
  Mutant MT-SP1 sequence; full length
  CB0383
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQLITPRMMCVGFLSGGVDSCQGDSGGPLSSVEADGRIFQAGVVSWGDGCAQRNLPGVYTRLPLFRDWIKENTGV

SEQ ID NO: 626 - protein, 855 aa, Homo sapiens
  Mutant MT-SP1 sequence; full length
  CB0357
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNLPGVYTRLPLFRDWIKENTGV

SEQ ID NO: 627 - protein, 855 aa, Homo sapiens
  Mutant MT-SP1 sequence; full length
  CB0387
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQWITPRMMCVGFLSGGVDSCQGDSGGPLSSVEADGRIFQAGVVSWGDGCAQRNLPGVYTRLPLFRDWIKENTGV

SEQ ID NO: 628 - protein, 855 aa, Homo sapiens
  Mutant MT-SP1 sequence; full length
  CB0238
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNLPGVYTRLPLFRDWIKENTGV

SEQ ID NO: 629 - protein, 855 aa, Homo sapiens
  Mutant MT-SP1 sequence; full length
  CB0458
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAERNRPGVYTRLPLFRDWIKENTGV

SEQ ID NO: 630 - protein, 855 aa, Homo sapiens
  Mutant MT-SP1 sequence; full length
  CB0235
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNAPGVYTRLPLFRDWIKENTGV

SEQ ID NO: 631 - protein, 855 aa, Homo sapiens
  Mutant MT-SP1 sequence; full length
  CB0381
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQHITPRMMCVGFLSGGVDSCQGDSGGPLSSVEADGRIFQAGVVSWGDGCAQRNLPGVYTRLPLFRDWIKENTGV

SEQ ID NO: 632 - protein, 855 aa, Homo sapiens
  Mutant MT-SP1 sequence; full length
  CB0388
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQYITPRMMCVGFLSGGVDSCQGDSGGPLSSVEADGRIFQAGVVSWGDGCAQRNLPGVYTRLPLFRDWIKENTGV

SEQ ID NO: 633 - protein, 855 aa, Homo sapiens
  Mutant MT-SP1 sequence; full length
  CB0257
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNYPGVYTRLPLFRDWIKENTGV

SEQ ID NO: 634 - protein, 855 aa, Homo sapiens
  Mutant MT-SP1 sequence; full length
  CB0385
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQFITPRMMCVGFLSGGVDSCQGDSGGPLSSVEADGRIFQAGVVSWGDGCAQRNLPGVYTRLPLFRDWIKENTGV

SEQ ID NO: 635 - protein, 855 aa, Homo sapiens
  Mutant MT-SP1 sequence; full length
  CB0021
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQEITPRMMCVGFLSGGVDSCQGDSGGPLSSVEADGRIFQAGVVSWGDGCAQRNKPGVYTRLPLFRDWIKENTGV

SEQ ID NO: 636 - protein, 855 aa, Homo sapiens
  Mutant MT-SP1 sequence; full length
  CB0020
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQDITPRMMCVGFLSGGVDSCQGDSGGPLSSVEADGRIFQAGVVSWGDGCAQRNKPGVYTRLPLFRDWIKENTGV

SEQ ID NO: 637 - protein, 855 aa, Homo sapiens
  Mutant MT-SP1 sequence; full length
  CB0245
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNNPGVYTRLPLFRDWIKENTGV

SEQ ID NO: 638 - protein, 855 aa, Homo sapiens
  Mutant MT-SP1 sequence; full length
  CB0451
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCALRNSPGVYTRLPLFRDWIKENTGV

SEQ ID NO: 639 - protein, 855 aa, Homo sapiens
  Mutant MT-SP1 sequence; full length
  CB0332
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHECGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNLPGVYTRLPLFRDWIKENTGV

SEQ ID NO: 640 - protein, 855 aa, Homo sapiens
  Mutant MT-SP1 sequence; full length
  CB0403
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGFGCAQRNLPGVYTRLPLFRDWIKENTGV

SEQ ID NO: 641 - protein, 856 aa, Homo sapiens
  Mutant MT-SP1 sequence; full length
  CB0353
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGVTQYDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 642 - protein, 855 aa, Homo sapiens
  Mutant MT-SP1 sequence; full length
  CB0213
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 643 - protein, 855 aa, Homo sapiens
  Mutant MT-SP1 sequence; full length
  CB0214
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQAGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 644 - protein, 855 aa, Homo sapiens
  Mutant MT-SP1 sequence; full length
  CB0255
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNTPGVYTRLPLFRDWIKENTGV

SEQ ID NO: 645 - protein, 855 aa, Homo sapiens
  Mutant MT-SP1 sequence; full length
  CB0423
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQQITPRMMCVGFLSGGVDSCQGDSGGPLSSVEADGRIFQAGVVSWGDGCAQRNLPGVYTRLPLFRDWIKENTGV

SEQ ID NO: 646 - protein, 855 aa, Homo sapiens; identical to SEQ ID NO: 431
  Mutant MT-SP1 sequence; full length
  CB0016

SEQ ID NO: 647 - protein, 855 aa, Homo sapiens
  Mutant MT-SP1 sequence; full length
  CB0017
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLNPQQITPRMMCVGFLSGGVDSCQGDSGGPLSSVEADGRIFQAGVVSWGDGCAQRNKPGVYTRLPLFRDWIKENTGV

SEQ ID NO: 648 - protein, 855 aa, Homo sapiens
  Mutant MT-SP1 sequence; full length
  CB0413
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHFCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 649 - protein, 855 aa, Homo sapiens
  Mutant MT-SP1 sequence; full length
  CB0412
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHLCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 650 - protein, 855 aa, Homo sapiens
  Mutant MT-SP1 sequence; full length
  CB0450
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 651 - protein, 855 aa, Homo sapiens
  Mutant MT-SP1 sequence; full length
  CB0409
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHACGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 652 - protein, 855 aa, Homo sapiens
  Mutant MT-SP1 sequence; full length
  CB0350
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHECGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 653 - protein, 855 aa, Homo sapiens
  Mutant MT-SP1 sequence; full length
  CB0331
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHDCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNLPGVYTRLPLFRDWIKENTGV

SEQ ID NO: 654 - protein, 855 aa, Homo sapiens
  Mutant MT-SP1 sequence; full length
  CB0349
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHDCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 655 - protein, 855 aa, Homo sapiens
  Mutant MT-SP1 sequence; full length
  CB0212
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQNGGTGALILQKGEIRVINQTTCENLLPQQITPRMMCVGFLSGGVDSCQGDSGGPLSSVEADGRIFQAGVVSWGDGCAQRNFPGVYTRLPLFRDWIKENTGV

SEQ ID NO: 656 - protein, 855 aa, Homo sapiens
  Mutant MT-SP1 sequence; full length
  CB0421
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQDITPRMMCVGFLSGGVDSCQGDSGGPLSSVEADGRIFQAGVVSWGDGCAQRNFPGVYTRLPLFRDWIKENTGV

SEQ ID NO: 657 - protein, 855 aa, Homo sapiens
  Mutant MT-SP1 sequence; full length
  CB0218
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCFGDSGGPLSSVEADGRIFQAGVVSWGDGCAQRNFPGVYTRLPLFRDWIKENTGV

SEQ ID NO: 658 - protein, 855 aa, Homo sapiens
  Mutant MT-SP1 sequence; full length
  CB0219
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCAGDSGGPLSSVEADGRIFQAGVVSWGDGCAQRNFPGVYTRLPLFRDWIKENTGV

SEQ ID NO: 659 - protein, 855 aa, Homo sapiens
  Mutant MT-SP1 sequence; full length
  CB0216
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCVGDSGGPLSSVEADGRIFQAGVVSWGDGCAQRNFPGVYTRLPLFRDWIKENTGV

SEQ ID NO: 660 - protein, 313 aa, Homo sapien
  Ficolin-2 (L- Ficolin)
MELDRAVGVLGAATLLLSFLGMAWALQAADTCPEVKMVGLEGSDKLTILRGCPGLPGAPGDKGEAGTNGKRGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 661 - protein, 326 aa, Homo sapien
  Ficolin-1 (M-Ficolin)
MELSGATMARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQGSSELRVDLVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 662 - protein, 299 aa, Homo sapien
  Ficolin-3 (H-ficolin/Hakata antigen)
MDLLWILPSLWLLLLGGPACLKTQEHPSCPGPRELEASKVVLLPSCPGAPGSPGEKGAPGPQGPPGPPGKMGPKGEPGDPVNLLRCQEGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 663 - protein, 855 aa, Homo sapiens
  Mutant MT-SP1 sequence; full length
  CB0476
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQDITPRMMCVGFLSGGVDSCQGDSGGPLSSVEADGRIFQAGVVSWGDGCAQRNLPGVYTRLPLFRDWIKENTGV

SEQ ID NO: 664 - protein, 855 aa, Homo sapiens
  Mutant MT-SP1 sequence; full length
  CB0477
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQDITPRMMCVGFLSGGVDSCQGDSGGPLSSVEADGRIFQAGVVSWGDGCAQRNRPGVYTRLPLFRDWIKENTGV

SEQ ID NO: 665 - protein, 855 aa, Homo sapiens
  Mutant MT-SP1 sequence; full length
  CB0478
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQDITPRMMCVGFLSGGVDSCQGDSGGPLSSVEADGRIFQAGVVSWGDGCAQRNNPGVYTRLPLFRDWIKENTGV

SEQ ID NO: 666 - protein, 855 aa, Homo sapiens
  Mutant MT-SP1 sequence; full length
  CB0480
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQDITPRMMCVGFLSGGVDSCQGDSGGPLSSVEADGRIFQAGVVSWGDGCAQRNFPGVYTRLPLFRDWIKENTGV

SEQ ID NO: 667 - protein, 855 aa, Homo sapiens
  Mutant MT-SP1 sequence; full length
  CB0481
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQDITPRMMCVGFLSGGVDSCQGDSGGPLSSVEADGRIFQAGVVSWGDGCAQRNLPGVYTRLPLFRDWIKENTGV

SEQ ID NO: 668 - protein, 855 aa, Homo sapiens
  Mutant MT-SP1 sequence; full length
  CB0482
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQDITPRMMCVGFLSGGVDSCQGDSGGPLSSVEADGRIFQAGVVSWGDGCAQRNRPGVYTRLPLFRDWIKENTGV

SEQ ID NO: 669 - protein, 855 aa, Homo sapiens
  Mutant MT-SP1 sequence; full length
  CB0483
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQDITPRMMCVGFLSGGVDSCQGDSGGPLSSVEADGRIFQAGVVSWGDGCAQRNNPGVYTRLPLFRDWIKENTGV

SEQ ID NO: 670 - protein, 855 aa, Homo sapiens
  Mutant MT-SP1 sequence; full length
  CB0484
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQDITPRMMCVGFLSGGVDSCQGDSGGPLSSVEADGRIFQAGVVSWGDGCAQRNFPGVYTRLPLFRDWIKENTGV

SEQ ID NO: 671 - protein, 855 aa, Homo sapiens
  Mutant MT-SP1 sequence; full length
  CB0485
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQDITPRMMCVGFLSGGVDSCQGDSGGPLSSVEADGRIFQAGVVSWGDGCAQRNLPGVYTRLPLFRDWIKENTGV

SEQ ID NO: 672 - protein, 241 aa, Homo sapiens
  Mutant MT-SP1 sequence; protease domain
  CB0476
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQDITPRMMCVGFLSGGVDSCQGDSGGPLSSVEADGRIFQAGVVSWGDGCAQRNLPGVYTRLPLFRDWIKENTGV

SEQ ID NO: 673 - protein, 241 aa, Homo sapiens
  Mutant MT-SP1 sequence; protease domain
  CB0477
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQDITPRMMCVGFLSGGVDSCQGDSGGPLSSVEADGRIFQAGVVSWGDGCAQRNRPGVYTRLPLFRDWIKENTGV

SEQ ID NO: 674 - protein, 241 aa, Homo sapiens
  Mutant MT-SP1 sequence; protease domain
  CB0478
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQDITPRMMCVGFLSGGVDSCQGDSGGPLSSVEADGRIFQAGVVSWGDGCAQRNNPGVYTRLPLFRDWIKENTGV

SEQ ID NO: 675 - protein, 241 aa, Homo sapiens
  Mutant MT-SP1 sequence; protease domain
  CB0480
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQDITPRMMCVGFLSGGVDSCQGDSGGPLSSVEADGRIFQAGVVSWGDGCAQRNFPGVYTRLPLFRDWIKENTGV

SEQ ID NO: 676 - protein, 241 aa, Homo sapiens
  Mutant MT-SP1 sequence; protease domain
  CB0481
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQDITPRMMCVGFLSGGVDSCQGDSGGPLSSVEADGRIFQAGVVSWGDGCAQRNLPGVYTRLPLFRDWIKENTGV

SEQ ID NO: 677 - protein, 241 aa, Homo sapiens
  Mutant MT-SP1 sequence; protease domain
  CB0482
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQDITPRMMCVGFLSGGVDSCQGDSGGPLSSVEADGRIFQAGVVSWGDGCAQRNRPGVYTRLPLFRDWIKENTGV

SEQ ID NO: 678 - protein, 241 aa, Homo sapiens
  Mutant MT-SP1 sequence; protease domain
  CB0483
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQDITPRMMCVGFLSGGVDSCQGDSGGPLSSVEADGRIFQAGVVSWGDGCAQRNNPGVYTRLPLFRDWIKENTGV

SEQ ID NO: 679 - protein, 241 aa, Homo sapiens
  Mutant MT-SP1 sequence; protease domain
  CB0484
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQDITPRMMCVGFLSGGVDSCQGDSGGPLSSVEADGRIFQAGVVSWGDGCAQRNFPGVYTRLPLFRDWIKENTGV

SEQ ID NO: 680 - protein, 241 aa, Homo sapiens
  Mutant MT-SP1 sequence; protease domain
  CB0485
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQEGGTGALILQKGEIRVINQTTCENLLPQDITPRMMCVGFLSGGVDSCQGDSGGPLSSVEADGRIFQAGVVSWGDGCAQRNLPGVYTRLPLFRDWIKENTGV

SEQ ID NO: 681 - protein, 855 aa, Homo sapiens
  Mutant MT-SP1 sequence; full length
  I41T/Y146D/G151L/K224N
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQQITPRMMCVGFLSGGVDSCQGDSGGPLSSVEADGRIFQAGVVSWGDGCAQRNNPGVYTRLPLFRDWIKENTGV

SEQ ID NO: 682 - protein, 855 aa, Homo sapiens
  Mutant MT-SP1 sequence; full length
  Y146D/Q175D/K224N
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQDITPRMMCVGFLSGGVDSCQGDSGGPLSSVEADGRIFQAGVVSWGDGCAQRNNPGVYTRLPLFRDWIKENTGV

SEQ ID NO: 683 - protein, 855 aa, Homo sapiens
  Mutant MT-SP1 sequence; full length
  I41T/Y146D/K224N
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNNPGVYTRLPLFRDWIKENTGV

SEQ ID NO: 684 - protein, 855 aa, Homo sapiens
  Mutant MT-SP1 sequence; full length
  Y146D/G151L/K224N
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQQITPRMMCVGFLSGGVDSCQGDSGGPLSSVEADGRIFQAGVVSWGDGCAQRNNPGVYTRLPLFRDWIKENTGV

SEQ ID NO: 685 - protein, 855 aa, Homo sapiens
  Mutant MT-SP1 sequence; full length
  Y146D/Q175R/K224N
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQRITPRMMCVGFLSGGVDSCQGDSGGPLSSVEADGRIFQAGVVSWGDGCAQRNNPGVYTRLPLFRDWIKENTGV

SEQ ID NO: 686 - protein, 855 aa, Homo sapiens
  Mutant MT-SP1 sequence; full length
  Y146D/Q175K/K224N
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQKITPRMMCVGFLSGGVDSCQGDSGGPLSSVEADGRIFQAGVVSWGDGCAQRNNPGVYTRLPLFRDWIKENTGV

SEQ ID NO: 687 - protein, 855 aa, Homo sapiens
  Mutant MT-SP1 sequence; full length
  Y146D/Q175H/K224N
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQHITPRMMCVGFLSGGVDSCQGDSGGPLSSVEADGRIFQAGVVSWGDGCAQRNNPGVYTRLPLFRDWIKENTGV

SEQ ID NO: 688 - protein, 855 aa, Homo sapiens
  Mutant MT-SP1 sequence; full length
  I41T/Y146D/G151L/Q175K/K224F
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQKITPRMMCVGFLSGGVDSCQGDSGGPLSSVEADGRIFQAGVVSWGDGCAQRNFPGVYTRLPLFRDWIKENTGV

SEQ ID NO: 689 - protein, 855 aa, Homo sapiens
  Mutant MT-SP1 sequence; full length
  I41T/Y146D/G151L/Q175R/K224F
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQRITPRMMCVGFLSGGVDSCQGDSGGPLSSVEADGRIFQAGVVSWGDGCAQRNFPGVYTRLPLFRDWIKENTGV

SEQ ID NO: 690 - protein, 855 aa, Homo sapiens
  Mutant MT-SP1 sequence; full length
  I41T/Y146D/G151L/Q175H/K224F
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQHITPRMMCVGFLSGGVDSCQGDSGGPLSSVEADGRIFQAGVVSWGDGCAQRNFPGVYTRLPLFRDWIKENTGV

SEQ ID NO: 691 - protein, 855 aa, Homo sapiens
  Mutant MT-SP1 sequence; full length
  I41T/Y146D/G151L/Q175Y/K224F
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQYITPRMMCVGFLSGGVDSCQGDSGGPLSSVEADGRIFQAGVVSWGDGCAQRNFPGVYTRLPLFRDWIKENTGV

SEQ ID NO: 692 - protein, 855 aa, Homo sapiens
  Mutant MT-SP1 sequence; full length
  I41T/Y146D/G151L/Q175K/K224N
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQKITPRMMCVGFLSGGVDSCQGDSGGPLSSVEADGRIFQAGVVSWGDGCAQRNNPGVYTRLPLFRDWIKENTGV

SEQ ID NO: 693 - protein, 855 aa, Homo sapiens
  Mutant MT-SP1 sequence; full length
  I41T/Y146D/G151L/Q175R/K224N
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQRITPRMMCVGFLSGGVDSCQGDSGGPLSSVEADGRIFQAGVVSWGDGCAQRNNPGVYTRLPLFRDWIKENTGV

SEQ ID NO: 694 - protein, 855 aa, Homo sapiens
  Mutant MT-SP1 sequence; full length
  I41T/Y146D/G151L/Q175H/K224N
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQHITPRMMCVGFLSGGVDSCQGDSGGPLSSVEADGRIFQAGVVSWGDGCAQRNNPGVYTRLPLFRDWIKENTGV

SEQ ID NO: 695 - protein, 855 aa, Homo sapiens
  Mutant MT-SP1 sequence; full length
  I41T/Y146D/G151L/Q175Y/K224N
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQYITPRMMCVGFLSGGVDSCQGDSGGPLSSVEADGRIFQAGVVSWGDGCAQRNNPGVYTRLPLFRDWIKENTGV

SEQ ID NO: 696 - protein, 241 aa, Homo sapiens
  Mutant MT-SP1 sequence; protease domain
  I41T/Y146D/G151L/K224N
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQQITPRMMCVGFLSGGVDSCQGDSGGPLSSVEADGRIFQAGVVSWGDGCAQRNNPGVYTRLPLFRDWIKENTGV

SEQ ID NO: 697 - protein, 241 aa, Homo sapiens
  Mutant MT-SP1 sequence; protease domain
  Y146D/Q175D/K224N
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQDITPRMMCVGFLSGGVDSCQGDSGGPLSSVEADGRIFQAGVVSWGDGCAQRNNPGVYTRLPLFRDWIKENTGV

SEQ ID NO: 698 - protein, 241 aa, Homo sapiens
  Mutant MT-SP1 sequence; protease domain
  I41T/Y146D/K224N
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQQITPRMMCVGFLSGGVDSCQGDSGGPLSSVEADGRIFQAGVVSWGDGCAQRNNPGVYTRLPLFRDWIKENTGV

SEQ ID NO: 699 - protein, 241 aa, Homo sapiens
  Mutant MT-SP1 sequence; protease domain
  Y146D/G151L/K224N
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQQITPRMMCVGFLSGGVDSCQGDSGGPLSSVEADGRIFQAGVVSWGDGCAQRNNPGVYTRLPLFRDWIKENTGV

SEQ ID NO: 700 - protein, 241 aa, Homo sapiens
  Mutant MT-SP1 sequence; protease domain
  Y146D/Q175R/K224N
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQRITPRMMCVGFLSGGVDSCQGDSGGPLSSVEADGRIFQAGVVSWGDGCAQRNNPGVYTRLPLFRDWIKENTGV

SEQ ID NO: 701 - protein, 241 aa, Homo sapiens
  Mutant MT-SP1 sequence; protease domain
  146D/Q175K/K224N
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQKITPRMMCVGFLSGGVDSCQGDSGGPLSSVEADGRIFQAGVVSWGDGCAQRNNPGVYTRLPLFRDWIKENTGV

SEQ ID NO: 702 - protein, 241 aa, Homo sapiens
  Mutant MT-SP1 sequence; protease domain
  Y146D/Q175H/K224N
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTGALILQKGEIRVINQTTCENLLPQHITPRMMCVGFLSGGVDSCQGDSGGPLSSVEADGRIFQAGVVSWGDGCAQRNNPGVYTRLPLFRDWIKENTGV

SEQ ID NO: 703 - protein, 241 aa, Homo sapiens
  Mutant MT-SP1 sequence; protease domain
  I41T/Y146D/G151L/Q175K/K224F
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQKITPRMMCVGFLSGGVDSCQGDSGGPLSSVEADGRIFQAGVVSWGDGCAQRNFPGVYTRLPLFRDWIKENTGV

SEQ ID NO: 704 - protein, 241 aa, Homo sapiens
  Mutant MT-SP1 sequence; protease domain
  I41T/Y146D/G151L/Q175R/K224F
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQRITPRMMCVGFLSGGVDSCQGDSGGPLSSVEADGRIFQAGVVSWGDGCAQRNFPGVYTRLPLFRDWIKENTGV

SEQ ID NO: 705 - protein, 241 aa, Homo sapiens
  Mutant MT-SP1 sequence; protease domain
  I41T/Y146D/G151L/Q175H/K224F
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQHITPRMMCVGFLSGGVDSCQGDSGGPLSSVEADGRIFQAGVVSWGDGCAQRNFPGVYTRLPLFRDWIKENTGV

SEQ ID NO: 706 - protein, 241 aa, Homo sapiens
  Mutant MT-SP1 sequence; protease domain
  I41T/Y146D/G151L/Q175Y/K224F
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQYITPRMMCVGFLSGGVDSCQGDSGGPLSSVEADGRIFQAGVVSWGDGCAQRNFPGVYTRLPLFRDWIKENTGV

SEQ ID NO: 707 - protein, 241 aa, Homo sapiens
  Mutant MT-SP1 sequence; protease domain
  I41T/Y146D/G151L/Q175K/K224N
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQKITPRMMCVGFLSGGVDSCQGDSGGPLSSVEADGRIFQAGVVSWGDGCAQRNNPGVYTRLPLFRDWIKENTGV

SEQ ID NO: 708 - protein, 241 aa, Homo sapiens
  Mutant MT-SP1 sequence; protease domain
  I41T/Y146D/G151L/Q175R/K224N
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQRITPRMMCVGFLSGGVDSCQGDSGGPLSSVEADGRIFQAGVVSWGDGCAQRNNPGVYTRLPLFRDWIKENTGV

SEQ ID NO: 709 - protein, 241 aa, Homo sapiens
  Mutant MT-SP1 sequence; protease domain
  I41T/Y146D/G151L/Q175H/K224N
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQHITPRMMCVGFLSGGVDSCQGDSGGPLSSVEADGRIFQAGVVSWGDGCAQRNNPGVYTRLPLFRDWIKENTGV

SEQ ID NO: 710 - protein, 241 aa, Homo sapiens
  Mutant MT-SP1 sequence; protease domain
  I41T/Y146D/G151L/Q175Y/K224N
VVGGTDADEGEWPWQVSLHALGQGHTCGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQDGGTLALILQKGEIRVINQTTCENLLPQYITPRMMCVGFLSGGVDSCQGDSGGPLSSVEADGRIFQAGVVSWGDGCAQRNNPGVYTRLPLFRDWIKENTGV

SEQ ID NO: 711 - protein, 6 aa, Artificial Sequence
  MT-SP1 substrate recognition site
RQARVV

SEQ ID NO: 712 - protein, 4 aa, Artificial Sequence
  serine protease conserved region
VVGG

SEQ ID NO: 713 - protein, 4 aa, Artificial Sequence
  Synthesized protease cleavage site
RRVR

SEQ ID NO: 714 - protein, 4 aa, Artificial Sequence
  serine protease conserved region
IIGG

SEQ ID NO: 715 - protein, 4 aa, Artificial Sequence
  serine protease conserved region
IVGG

SEQ ID NO: 716 - protein, 4 aa, Artificial Sequence
  MT-SP1 substrate cleavage residue
KRSR

SEQ ID NO: 717 - protein, 4 aa, Artificial Sequence
  PAR-2 cleavage residue
SKGR

SEQ ID NO: 718 - protein, 4 aa, Artificial Sequence
  MT-SP1 substrate cleavage residue
REAR

SEQ ID NO: 719 - protein, 4 aa, Artificial Sequence
  MT-SP1 substrate cleavage residue
PRFK

SEQ ID NO: 720 - protein, 4 aa, Artificial Sequence
  MT-SP1 substrate cleavage residue
KEGR

SEQ ID NO: 721 - protein, 4 aa, Artificial Sequence
  C2 cleavage sequence
GATR

SEQ ID NO: 722 - protein, 4 aa, Artificial Sequence
  C2 cleavage sequence
SLGR

SEQ ID NO: 723 - protein, 4 aa, Artificial Sequence
  C2 cleavage sequence
VFAK

SEQ ID NO: 724 - protein, 6 aa, Artificial Sequence
  Factor I target cleavage sequence
LPSRKI

SEQ ID NO: 725 - protein, 6 aa, Artificial Sequence
  Factor I target cleavage sequence
SLLRSE

SEQ ID NO: 726 - protein, 6 aa, Artificial Sequence
  Factor I target cleavage sequence
HRGRTL

What is claimed is:

1. A modified membrane-type serine protease 1 (MT-SP1) protease, or catalytically active portion thereof, comprising amino acid replacements in an unmodified MT-SP 1 protease, or a catalytically active portion thereof, wherein:
the amino acid replacement corresponds to Q175L, based on chymotrypsin numbering;
the unmodified MT-SP 1 protease and catalytically active portion thereof comprises a sequence of amino acids set forth in SEQ ID NO: 2 and 10, respectively, or comprises a catalytically active portion of the polypeptide of SEQ ID NO:2 or 10;
the full-length form of the modified MT-SP1 has at least 95% sequence identity with the unmodified MT-SP1 of SEQ ID NO:2, or the catalytically active portion has at least 95% sequence identity with SEQ ID NO: 10; and
the modified MT-SP 1 protease, or the catalytically active portion thereof cleaves a complement protein,
wherein the complement protein is selected from the group consisting of C1q, C1r, C1s, C2, C3, C3a, C3b, C3c, C3dg, C3g, C3d, C3f, iC3, C3a-desArg, C4, C4a, C4b, iC4, C4a-desArg, C5, C5a, C5a-des-Arg, C6, C7, C8, C9, MASP-1, MASP-2, MBL, Factor B, Factor D, Factor H, Factor I, CR1, CR2, CR3, CR4, properdin, ClInh, C4bp, MCP, DAF, CD59 (MIRL), clusterin and HRF and allelic and species variants thereof.

2. The modified MT-SP1 protease, or catalytically active portion thereof, of claim 1, wherein the unmodified MT-SP1 protease consists of the sequence of amino acids set forth in SEQ ID NO:2.

3. The modified MT-SP1 protease, or catalytically active portion thereof, of claim 1, wherein the unmodified MT-SP1 consists of the sequence of amino acids set forth in SEQ ID NO:10.

4. The modified MT-SP1 protease, or catalytically active portion thereof, of claim 1, further comprising an amino acid replacement at one or both of positions 151 or 192, by chymotrypsin numbering.

5. The modified MT-SP1 protease, or catalytically active portion thereof, of claim 1, wherein the complement protein is C2 or C3.

6. A composition, comprising the modified MT-SP1 protease, or catalytically active portion thereof, of claim 1.

7. A method of inhibiting complement activation, comprising contacting a modified MT-SP1 protease, or catalytically active portion thereof, of claim 1 with a complement protein, whereby the modified MT-SP1 protease, or a catalytically active portion thereof, cleaves the complement protein such that complement activation in the pathway comprising the complement protein is inhibited.

8. The method of claim 7, wherein contacting is effected in vivo in a subject having a complement-mediated disorder associated with complement activation to inhibit complement activation, thereby reducing inflammatory symptoms associated with the complement-mediated disorder.

9. The method of claim 8, wherein the complement-mediated disorder is selected from among an inflammatory disorder, a neurodegenerative disorder and a cardiovascular disorder.

10. The method of claim 7, wherein the target substrate is C2 or C3.

11. The modified MT-SP1 protease, or catalytically active portion thereof of claim 5, wherein the complement protein is C3.

12. A modified membrane-type serine protease 1 (MT-SP1) protease, or catalytically active portion thereof, comprising amino acid replacements in an unmodified MT-SP1 protease, or a catalytically active portion thereof, wherein:
the amino acid replacement corresponds to Q175L, based on chymotrypsin numbering;
the unmodified MT-SP1 protease and catalytically active portion thereof comprises a sequence of amino acids set forth in SEQ ID NO: 2 and 10 respectively, or has up to 14 amino acid replacements in the polypeptide of SEQ ID NO:2 or 10; and
the modified MT-SP1 protease, or the catalytically active portion thereof, exhibits increased $k_{cat}/K_m$ for a complement protein compared to the $k_{cat}/K_m$ of the unmodified MT-SP1, or the catalytically active portion thereof, thereby inhibiting complement activation.

* * * * *